United States Patent
Haynes et al.

(10) Patent No.: US 10,149,902 B2
(45) Date of Patent: Dec. 11, 2018

(54) SWARM IMMUNIZATION WITH ENVELOPES FROM CH505

(71) Applicants: Duke University, Durham, NC (US); Los Alamos National Security, LLC, Los Alamos, NM (US)

(72) Inventors: Barton F. Haynes, Durham, NC (US); Feng Gao, Durham, NC (US); Bette T. Korber, Los Alamos, NM (US); Peter T. Hraber, Los Alamos, NM (US)

(73) Assignees: DUKE UNIVERSITY, Durham, NC (US); LOS ALAMOS NATIONAL SECURITY, LLC, Los Alamos, NM (US)

(*) Notice: Subject to any disclaimer, the term of this patent is extended or adjusted under 35 U.S.C. 154(b) by 0 days.

(21) Appl. No.: 15/126,220

(22) PCT Filed: Mar. 19, 2015

(86) PCT No.: PCT/US2015/021528
§ 371 (c)(1),
(2) Date: Sep. 14, 2016

(87) PCT Pub. No.: WO2015/143193
PCT Pub. Date: Sep. 24, 2015

(65) Prior Publication Data
US 2017/0080082 A1    Mar. 23, 2017

Related U.S. Application Data

(60) Provisional application No. 61/955,402, filed on Mar. 19, 2014.

(51) Int. Cl.
| | | |
|---|---|---|
| A61K 39/21 | (2006.01) | |
| A61K 39/00 | (2006.01) | |
| C07H 21/04 | (2006.01) | |
| A61K 39/12 | (2006.01) | |
| A61K 39/395 | (2006.01) | |
| C07K 14/005 | (2006.01) | |
| C12N 7/00 | (2006.01) | |

(52) U.S. Cl.
CPC .............. *A61K 39/21* (2013.01); *A61K 39/12* (2013.01); *C07K 14/005* (2013.01); *C12N 7/00* (2013.01); *A61K 2039/53* (2013.01); *A61K 2039/55555* (2013.01); *A61K 2039/55572* (2013.01); *A61K 2039/55577* (2013.01); *A61K 2039/70* (2013.01); *C12N 2710/24143* (2013.01); *C12N 2740/16134* (2013.01)

(58) Field of Classification Search
CPC ........ C07K 14/005; C12N 2740/16122; C12N 2740/16134; A61K 39/12; A61K 2039/53
See application file for complete search history.

(56) References Cited

U.S. PATENT DOCUMENTS

| 7,951,377 B2 | 5/2011 | Korber et al. |
| 2011/0311585 A1 | 12/2011 | Berman et al. |

FOREIGN PATENT DOCUMENTS

| WO | WO-2013/006688 A2 | 1/2013 |
| WO | WO-2014/042669 A1 | 3/2014 |
| WO | WO-2015/143193 A1 | 9/2015 |
| WO | WO-2016/014721 A2 | 1/2016 |
| WO | WO-2016/054081 A1 | 4/2016 |

OTHER PUBLICATIONS

GenBank: KC247557.1 HIV-1 isolate 703010505_w4_03 from Malawi envelope glycoprotein (env) gene, complete cds; and vpu protein (vpu), rev protein (rev), and tat protein (tat) genes, partial cds.*
Arnaoty, A., et al., "Novel Approach for the Development of New Antibodies Directed Against Transposase-Derived Proteins Encoded by Human Neogenes," Yves Bigot (ed.), Mobile Genetic Elements: Protocols and Genomic Applications, Methods in Molecular Biology, vol. 859, Chapter 17, pp. 293-305 (2012).
Arnaoty, A., et al., "Reliability of the nanopheres-DNA immunization technology to produce polyclonal antibodies directed against human neogenic proteins," Mol. Genet. Genomics, vol. 288, pp. 347-363 (2013).
Barouch, D. H., et al., "Mosaic HIV-1 Vaccines Expand the Breadth and Depth of Cellular Immune Responses in Rhesus Monkeys," Nature Med., vol. 16, No. 3, pp. 319-323, Author Manuscript—15 total pages (Mar. 2010).
Batista, F. D. and Neuberger, M. S., "Affinity Dependence of the B Cell Response to Antigen: A Threshold, a Ceiling, and the Improtance of Off-Rate," Immunity, vol. 8, pp. 751-759 (Jun. 1998).
Cany, J., et al., "AFP-specific immunotherapy impairs growth of autochthonous hepatocellular carcinoma in mice," Journal of Hepatology, vol. 54, pp. 115-121 (2011).
Chen, C., et al., "The site and stage of anti-DNA B-cell deletion," Nature, vol. 373, pp. 252-255 (Jan. 19, 1995).
Goepfert, et al., "Specificity and 6-Month Durability of Immune Responses Induced by DNA and Recombinant Modified Vaccinia Ankara Vaccines Expressing HIV-1 Virus-Like Particles" J Infect Dis., vol. 210, pp. 99-110 (Jul. 1, 2014).
Graham, et al., "DNA Vaccine Delivered by a Needle-Free Injection Device Improves Potency of Priming for Antibody and CD8+ T-Cell Responses after rAd5 Boost in a Randomized Clinical Trial," PLoS One, vol. 8, Issue 4, e59340, pp. 1-11 (Apr. 2013).
Haynes, B.F., et al., "B-cell-lineage immunogen design in vaccine development with HIV-1 as a case study," Nat. Biotechnol., vol. 30, No. 5, pp. 423-433 (May 2012).

(Continued)

*Primary Examiner* — Barry A Chestnut
(74) *Attorney, Agent, or Firm* — Wilmer Cutler Pickering Hale and Dorr LLP

(57) ABSTRACT

In certain aspects the invention provides HIV-1 immunogens, including envelopes (CH505) and selections therefrom, and methods for swarm immunizations using combinations of HIV-1 envelopes.

20 Claims, 313 Drawing Sheets
Specification includes a Sequence Listing.

(56) References Cited

OTHER PUBLICATIONS

Kepler, T.B. and Perelson, A.S., "Somatic Hypermutation in B Cells: An Optimal Control Treatment," J. Theo. Biol., vol. 164, pp. 37-64 (1993).
Kibler, K.V., et al., "Improved NYVAC-Based Vaccine Vectors," PLoS One, vol. 6, Issue 11, e25674, pp. 1-13 (Nov. 2011).
Leroux-Roels, I., et al., "Strong and persistent CD4+ T-cell response in healthy adults immunized with a candidate HIV-1 vaccine containing gp120, Nef and Tat antigens formulated in three Adjuvant Systems," Vaccine, vol. 28, pp. 7016-7024 (2010).
Liao, H.-X., et al., "Co-evolution of a broadly neutralizing HIV-1 antibody and founder virus," Nature, vol. 496, No. 7446, pp. 469-476, Author Manuscript—25 pages (Apr. 25, 2013).
Liao, H.-X., et al., "Initial antibodies binding to HIV-1 gp41 in acutely infected subjects are polyreactive and highly mutated," J. Exp. Med., vol. 208, No. 11, pp. 1-13 (Oct. 10, 2011).
Lynch, R. M. et al., "The Development of CD4 Binding Site Antibodies During HIV-1 Infection," J. Virol., vol. 86, No. 14, pp. 7588-7595 (Jul. 2012).
Mascola, J. R. and Haynes, B. F., "HIV-1 neutralizing antibodies: understanding nature's pathways," Immunol. Rev., vol. 254, No. 1, pp. 225-244, Author Manuscript—29 pages (Jul. 2013).
Meffre, E., et al., "Immunoglobulin heavy chain expression shapes the B cell receptor repertoire in human B cell development," The Journal of Clinical Investigation, vol. 108, No. 6, pp. 879-886 (Sep. 2001).
Moore, P. L., et al., "Evolution of an HIV glycan-dependent broadly neutralizing antibody epitope through immune escape," Nature Med., vol. 18, No. 11, pp. 1688-1692, Author Manuscript—12 pages (Nov. 2012).
Morris, L., et al., "Isolation of a Human Anti-HIV gp41 Membrane Proximal Region Neutralizing Antibody by Antigen-Specific Single B Cell Sorting," PLoS One, vol. 6, Issue 9, e23532, pp. 1-10 (Sep. 2011).
NCBI—GenBank Accession No. KC247557.1, pp. 1-3 (Apr. 22, 2013).
NCBI, GenBank accession No. AGG24899.1, pp. 1-2 (Apr. 22, 2013).
NCBI, GenBank accession No. AGG24985.1, pp. 1-2 (Apr. 22, 2013).
Perreau, M., et al., "DNA/NYVAC Vaccine Regimen Induces HIV-Specific CD4 and CD8 T-Cell Responses in Intestinal Mucosa," J. Virology, vol. 85, No. 19, pp. 9854-9862 (Oct. 2011).
Santra, S., et al., "Mosaic Vaccines Elicit CD8+ T lymphocyte Responses in Monkeys that Confer Enhanced Immune Coverage of Diverse HIV Strains," Nature Med., vol. 16, No. 3, pp. 324-328, Author Manuscript—13 pages in total (Mar. 2010).
Shiokawa, S., et al., "IgM Heavy Chain Complementarity-Determining Region 3 Diversity Is Constrained by Genetic and Somatic Mechanisms Until Two Months After Birth," The Journal of Immunology, vol. 162, pp. 6060-6070, 12 pages in total (1999).
Tomaras, G. D., et al., "Initial B-Cell Responses to Transmitted Human Immunodeficiency Virus Type 1: Virion-Binding Immunoglobulin M (IgM) and IgG Antibodies Followed by Plasma Anti-gp41 Antibodies with Ineffective Control of Initial Viremia," J. Virol., vol. 82, No. 24, pp. 12449-12463 (Dec. 2008).
Verkoczy, L., et al., "Autoreactivity in an HIV-1 broadly reactive neutralizing antibody variable region heavy chain induces immunologic tolerance," PNAS, vol. 107, No. 1, pp. 181-186 (Jan. 5, 2010).
Verkoczy, L., et al., "Induction of HIV-1 Broad Neutralizing Antibodies in 2F5 Knock-in Mice: Selection against Membrane Proximal External Region-Associated Autoreactivity Limits T-Dependent Responses," J. Immunol., vol. 191, pp. 2538-2550, 14 pages in total (Aug. 2013).
Verkoczy, L., et al., "Rescue of HIV-1 Broad Neutralizing Antibody-Expressing B Cells in 2F5 $V_H$ x $V_L$ Knockin Mice Reveals Multiple Tolerance Controls," The Journal of Immunology, vol. 187, pp. 3785-3797 (2011).
Verkoczy, L., et al., "Role of immune mechanisms in induction of HIV-1 broadly neutralizing antibodies," Curr. Opin. Immunol., vol. 23, No. 3, pp. 383-390, Author Manuscript—12 pages (Jun. 2011).
Yu, J.-S., et al., "Generation of Mucosal Anti-Human Immunodeficiency Virus Type 1 T-Cell Responses by Recombinant *Mycobacterium smegmatis*," Clinical and Vaccine Immunology, vol. 13, No. 11, pp. 1204-1211 (Nov. 2006).
Yu, J.-S., et al., "Recombinant *Mycobacterium bovis* Bacillus Calmette-Guérin Elicits Human Immunodeficiency Virus Type 1 Envelope-Specific T Lymphocytes at Mucosal Sites," Clinical and Vaccine Immunology, vol. 14, No. 7, pp. 886-893 (Jul. 2007).
Zhang, J., et al., "Optimality of Mutation and Selection in Germinal Centers," PLoS, vol. 6, Issue 6, e1000800, pp. 1-9 (Jun. 2010).
Zhou, T., et al., "Multi-donor Analysis Reveals Structural Elements, Genetic Determinants, and Maturation Pathway for Effective HIV-1 Neutralization by VRC01-class Antibodies," Immunity, vol. 39, No. 2, pp. 245-258, Author Manuscript—26 pages (Aug. 22, 2013).
Li, Y., et al., "Control of expression, glycosylation, and secretion of HIV-1 gp120 by homologous and heterologous signal sequences," Virology, vol. 204, No. 1, pp. 266-278, abstract—2 pages in total (Oct. 1994).
Li, Y., et al., "Effects of inefficient cleavage of the signal sequence of HIV-1 gp120 on its association with calnexin, folding, and intracellular transport," PNAS, vol. 93, pp. 9606-9611 (Sep. 1996).
Extended European Search Report issued by the European Patent Office dated Nov. 27, 2017 in European Patent Application No. 15764507.8 (18 total pages).
International Search Report and Written Opinion issued in PCT/US15/21528 dated Jul. 30, 2015 by Korean Intellectual Property Office as International Searching Authority (14 total pages).
Liao, H.-X., et al., "Antigenicity and Immunogenicity of Transmitted/Founder, Consensus, and Chronic Envelope Glycoproteins of Human Immunodeficiency Virus Type 1," Journal of Virology, vol. 87, No. 8, pp. 4185-4201, with Supplementary Materials—34 total pages (Apr. 2013).
Gao, F. et al., "Antigenicity and Immunogenicity of a Synthetic Human Immunodeficiency Virus Type 1 Group M Consensus Envelope Glycoprotein," Journal of Virology, vol. 79, No. 2, pp. 1154-1163 (Jan. 2005).
Binley, J.M., et al., "Enhancing the Proteolytic Maturation of Human Immunodeficiency Virus Type 1 Envelope Glycoproteins," Journal of Virology, vol. 76, No. 6, pp. 2606-2616 (Mar. 2002).
Liao, H.-X., et al., "A Group M Consensus Envelope Glycoprotein Induces Antibodies That Neutralize Subsets of Subtype B and C HIV-1 Primary Viruses," Virology, vol. 353, No. 2, pp. 268-282, Author Manuscript—30 pages (Sep. 30, 2006).
Bosch, V. and Pawlita, M., "Mutational Analysis of the Human Immunodeficiency Virus Type 1 env Gene Product Proteolytic Cleavage Site," Journal of Virology, vol. 64, No. 5, pp. 2337-2344 (May 1990).
Guo, H.-G., et al., "Characterization of an HIV-1 Point Mutant Blocked in Envelope Glycoprotein Cleavage," Virology, vol. 174, pp. 217-224 (1990).
McCune, J.M., et al., "Endoproteolytic Cleavage of gp160 Is Required for the Activation of Human Immunodeficiency Virus," Cell, vol. 53, pp. 55-67 (Apr. 8, 1988).
Chakrabarti, B.K., et al., "Modifications of the Human Immunodeficiency Virus Envelope Glycoprotein Enhance Immunogenicity for Genetic Immunization," Journal of Virology, vol. 76, No. 11, pp. 5357-5368 (Jun. 2002).
Li, Y., et al., "Control of expression, glycosylation, and secretion of HIV-1 gp120 by homologous and heterologous signal sequences," Virology, vol. 204, No. 1, pp. 266-278 (Oct. 1994).
Langedijk, J.P.M. and Schuitemaker, H., "A sweet surprise for HIV broadly neutralizing antibodies," Nature Medicine, vol. 18, No. 11, pp. 1616-1617 (Nov. 2012).
Haynes, B.F. and Montefiori, D.C., "Aiming to induce broadly reactive neutralizing antibody responses with HIV-1 vaccine candidates," Expert Rev. Vaccines, vol. 5, No. 3, pp. 579-595 (2006).
Walker, L.M., et al., "Broad and Potent Neutralizing Antibodies from an African Donor Reveal a New HIV-1 Vaccine Target," Science, vol. 326, pp. 285-289 (Oct. 9, 2009).

(56) References Cited

OTHER PUBLICATIONS van Gils, M.J. and Sanders, R.W., "Broadly neutralizing antibodies against HIV-1: Templates for a vaccine," Virology vol. 435, pp. 46-56 (2013).
Gray, E.S., et al., "The Neutralization Breadth of HIV-1 Develops Incrementally over Four Years and Is Associated with CD4 T Cell Decline and High Viral Load during Acute Infection," Journal of Virology, vol. 85, No. 10, pp. 4828-4840 (May 2011).
Gao, F., et al., "Cooperation of B Cell Lineages in Induction of HIV-1-Broadly Neutralizing Antibodies," Cell, vol. 158, pp. 481-491 (Jul. 31, 2014).
Bonsignori, M., et al., "Maturation Pathway from Germline to Broad HIV-1 Neutralizer of a CD4-Mimic Antibody," Cell, vol. 165, pp. 449-463 (Apr. 7, 2016).

\* cited by examiner

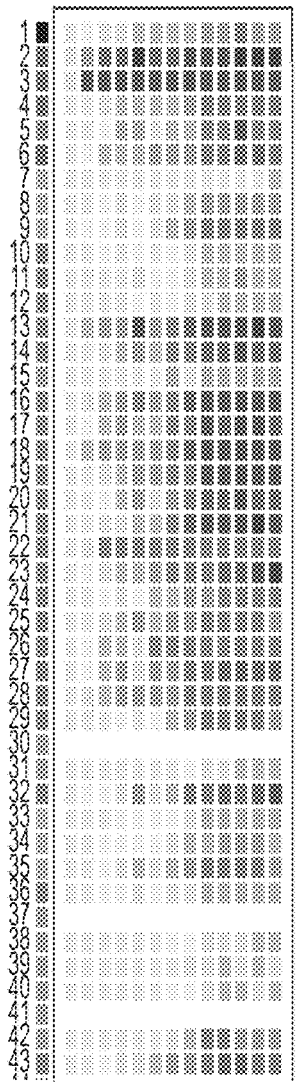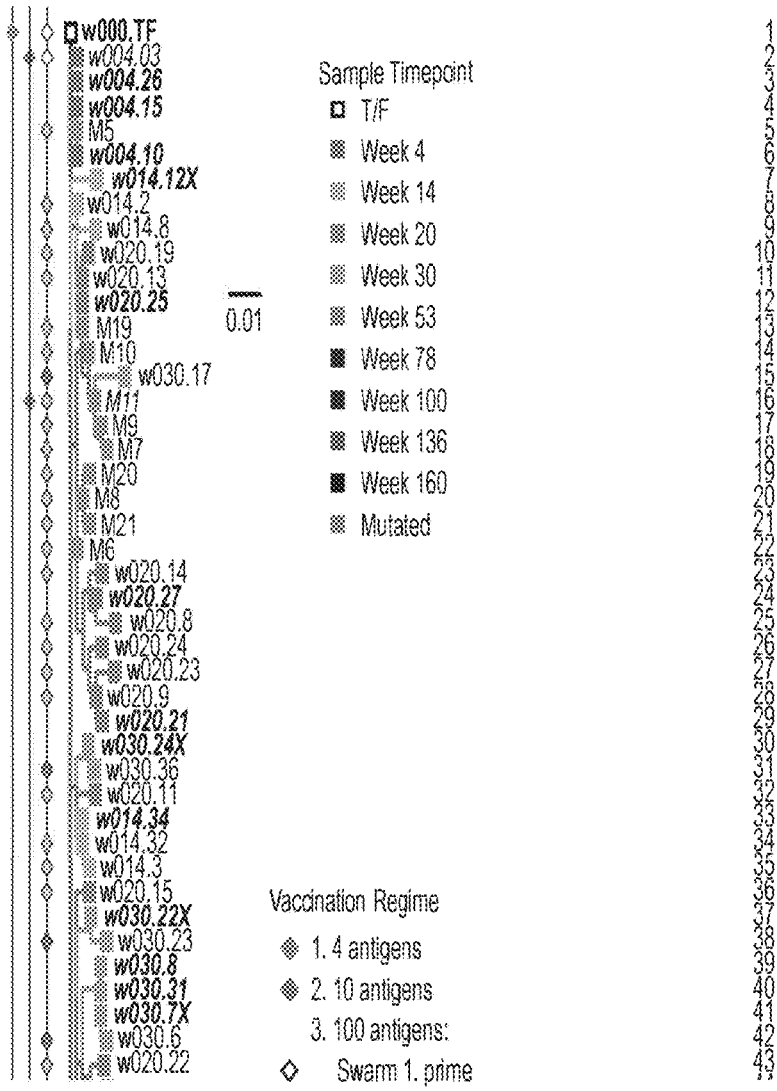
Figures 1B-C

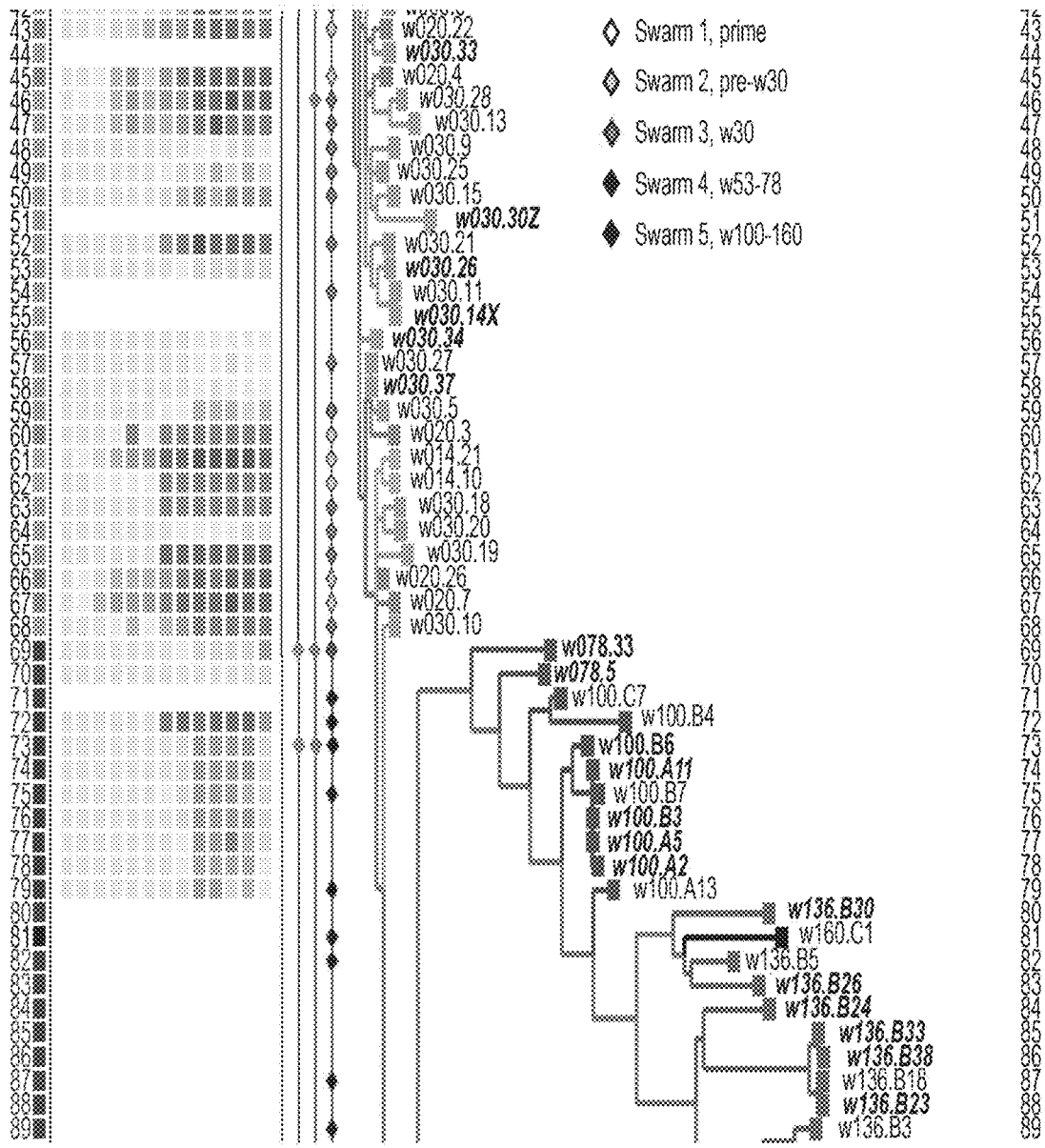
Figures 1B-C (cont.)

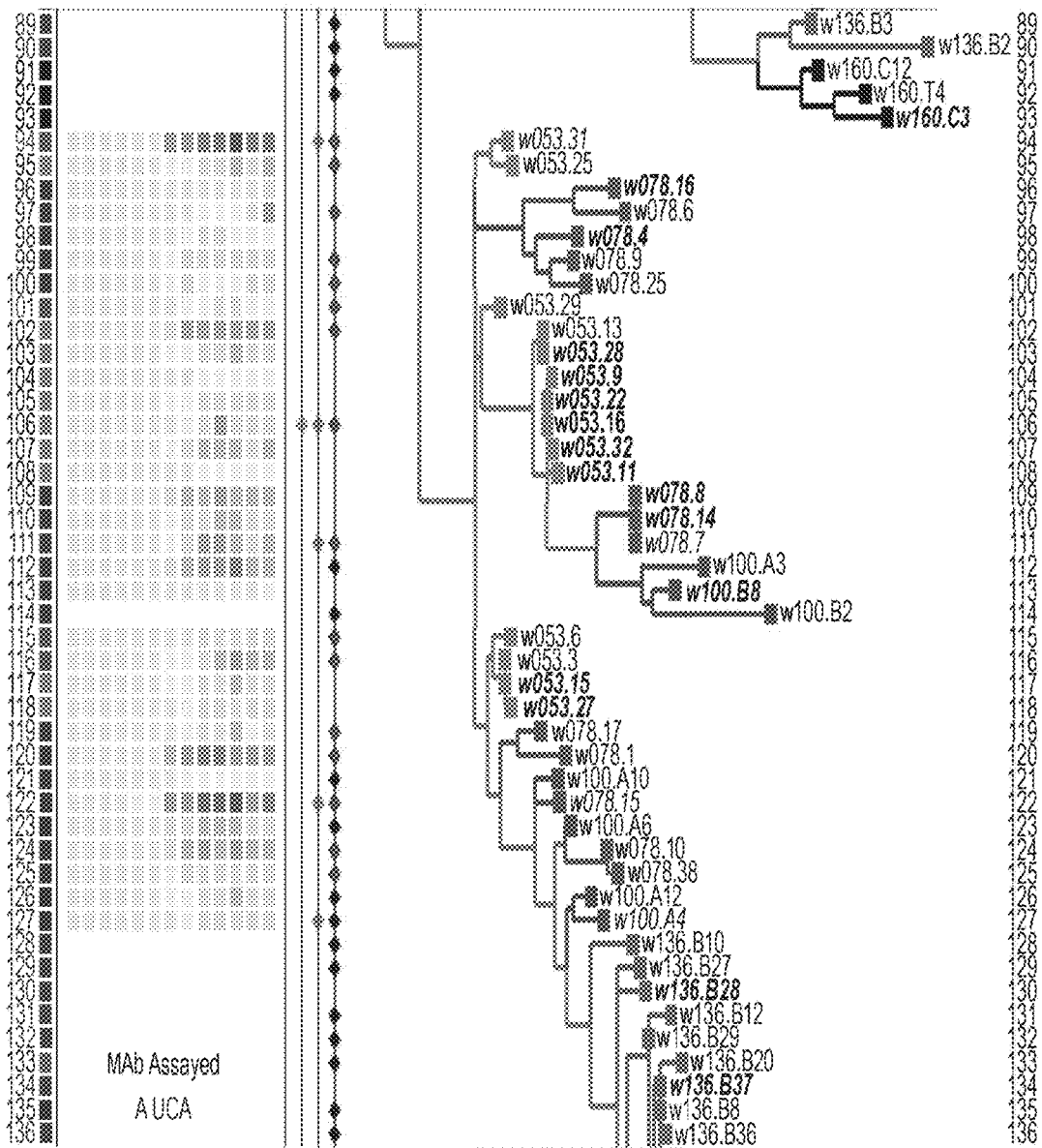
Figures 1B-C (cont.)

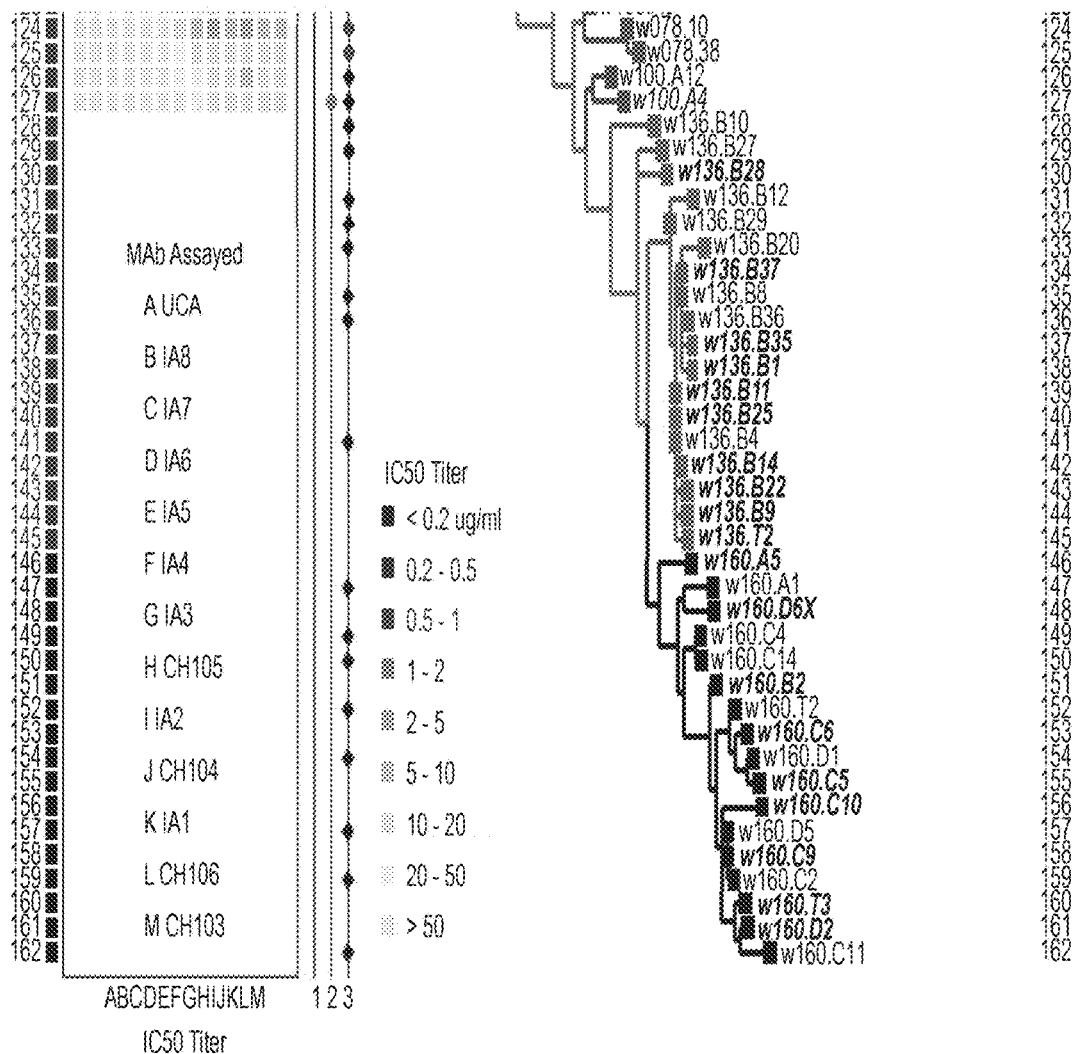
Figures 1B-C (cont.)

Table 1. Alignment columns in Env "hot-spot" concatamer summaries.

| Col | Aln | HXB2 | AA | CH505 | Feature |
|---|---|---|---|---|---|
| A: 36 sites with T/F < 20% | | | | | |
| 1 | 357 | 279 | D | N | Loop D |
| 2 | 359 | 281 | A | V | Loop D |
| 3 | 412 | 332 | O | N | PGT121 |
| 4 | 414 | 334 | S | O | 2G12 |
| 5 | 214 | 144+ | — | — | V1 |
| 6 | 215 | 144+ | — | — | V1 |
| 7 | 213 | 144+ | — | — | V1 |
| 8 | 495 | 413 | T | T | V4 |
| 9 | 552 | 465 | S | — | V5 |
| 10 | 551 | 464 | E | — | V5 |
| 11 | 499 | 417 | P | H | V4 |
| 12 | 410 | 330 | H | Y | V3 |
| 13 | 379 | 300 | N | N | V3 |
| 14 | 312 | 234 | O | T | 8ANC195 |
| 15 | 381 | 302 | N | K | V3 |
| 16 | 844 | 756 | I | V | |
| 17 | 550 | 463+ | — | — | V5 |
| 18 | 480 | 398 | S | O | V4 |
| 19 | 196 | 133 | D | O | V1 |
| 20 | 542 | 460 | N | K | V5 |
| 21 | 427 | 347 | S | K | |
| 22 | 353 | 275 | V | E | Loop D |
| 23 | 222 | 151 | K | I | V1 |
| 24 | 437 | 356 | O | H | |
| 25 | 558 | 471 | G | G | beta24 |
| 26 | 218 | 147 | M | O | V1 |
| 27 | 727 | 640 | S | E | * |
| 28 | 544 | 462 | N | N | V5 |
| 29 | 216 | 145 | G | A | V1 |
| 30 | 193 | 130 | K | O | |
| 31 | 195 | 132 | T | T | V1 |
| 32 | 707 | 620 | E | G | |
| 33 | 4 | 4 | K | M | SignalPep |
| 34 | 405 | 325 | N | D | V3 |
| 35 | 259 | 185 | D | D | V2 |
| 36 | 494 | 412 | D | R | V4 |
| B: 28 signature sites, q<0.1 | | | | | |
| 37 | 193 | 130 | K | O | |
| 38 | 195 | 132 | T | T | V1 |
| 39 | 196 | 133 | D | O | V1 |
| 40 | 198 | 135 | K | T | V1 |
| 41 | 200 | 137 | D | — | V1 |
| 42 | 217 | 146 | R | S | V1 |
| 43 | 219 | 148 | I | S | V1 |
| 44 | 218 | 147 | M | O | V1 |
| 45 | 220 | 149 | M | S | V1 |
| 46 | 222 | 151 | K | I | V1 |
| 47 | 231 | 160 | O | O | PG9 |
| 48 | 278 | 200 | V | V | |
| 49 | 312 | 234 | O | T | 8ANC195 |
| 50 | 408 | 328 | Q | E | V3 |
| 51 | 412 | 332 | O | N | PGT121 |
| 52 | 414 | 334 | S | O | 2G12 |
| 53 | 416 | 336 | A | S | |
| 54 | 427 | 347 | S | K | |
| 55 | 437 | 356 | O | H | |
| 56 | 439 | 358 | T | O | |
| 57 | 441 | 360 | I | T | |
| 58 | 498 | 416 | L | I | V4 |
| 59 | 542 | 460 | N | K | V5 |
| 60 | 543 | 461 | S | O | V5 |
| 61 | 545 | 463 | O | T | V5 |
| 62 | 831 | 743 | D | O | Kennedy |
| 63 | 833 | 745 | S | S | Epitope |
| 64 | 926 | 831 | E | E | LLP-1 |
| C: 22 varying contacts | | | | | |
| 65 | 190 | 127 | V | V | CD4 |
| 66 | 357 | 279 | D | N | Loop D |
| 67 | 358 | 280 | N | N | Loop D |
| 68 | 359 | 281 | A | V | Loop D |
| 69 | 360 | 282 | K | K | Loop D |
| 70 | 361 | 283 | T | T | Loop D |
| 71 | 446 | 365 | S | S | CD4 |
| 72 | 450 | 369 | P | L | CD4 |
| 73 | 452 | 371 | I | I | CD4 |
| 74 | 542 | 460 | N | K | V5 |
| 75 | 543 | 461 | S | O | V5 |
| 76 | 544 | 462 | N | N | V5 |
| 77 | 545 | 463 | O | T | V5 |
| 78 | 546 | 463+ | — | — | V5 |
| 79 | 547 | 463+ | — | — | V5 |
| 80 | 548 | 463+ | — | — | V5 |
| 81 | 549 | 463+ | — | — | V5 |
| 82 | 550 | 463+ | — | — | V5 |
| 83 | 558 | 471 | G | G | beta24 |
| 84 | 559 | 472 | G | G | CD4 |
| 85 | 561 | 474 | D | N | CD4 |
| 86 | 563 | 476 | R | K | CD4 |

Fig. 3

Table 1A. Alignment columns in Env "hot-spot" concatamer summaries.

| Col | Aln | HXB2 | AA | CH505 | Feature |
|---|---|---|---|---|---|
| | | 43 | 219 | 148 | I | S | V1 |

| Col | Aln | HXB2 | AA | CH505 | Feature | Col | Aln | HXB2 | AA | CH505 | Feature |
|---|---|---|---|---|---|---|---|---|---|---|---|
| A: 36 sites with T/F < 20% | | | | | | 43 | 219 | 148 | I | S | V1 |
| 1 | 357 | 279 | D | N | Loop D | 44 | 218 | 147 | M | O | V1 |
| 2 | 359 | 281 | A | V | Loop D | 45 | 220 | 149 | M | S | V1 |
| 3 | 412 | 332 | O | N | PGT121 | 46 | 222 | 151 | K | I | V1 |
| 4 | 414 | 334 | S | O | 2G12 | 47 | 231 | 160 | O | O | PG9 |
| 5 | 214 | 144+ | - | - | V1 | 48 | 278 | 200 | V | V | |
| 6 | 215 | 144+ | - | - | V1 | 49 | 312 | 234 | O | T | 8ANC195 |
| 7 | 213 | 144+ | - | - | V1 | 50 | 408 | 328 | Q | E | V3 |
| 8 | 495 | 413 | T | T | V4 | 51 | 412 | 332 | O | N | PGT121 |
| 9 | 552 | 465 | S | - | V5 | 52 | 414 | 334 | S | O | 2G12 |
| 10 | 551 | 464 | E | - | V5 | 53 | 416 | 336 | A | S | |
| 11 | 499 | 417 | P | H | V4 | 54 | 427 | 347 | S | K | |
| 12 | 410 | 330 | H | Y | V3 | 55 | 437 | 356 | O | H | |
| 13 | 379 | 300 | N | N | V3 | 56 | 439 | 358 | T | O | |
| 14 | 313 | 234 | O | T | 8ANC195 | 57 | 441 | 360 | I | T | |
| 15 | 381 | 302 | N | K | V3 | 58 | 498 | 416 | L | I | V4 |
| 16 | 844 | 756 | I | V | | 59 | 542 | 460 | N | K | V5 |
| 17 | 550 | 463+ | - | - | V5 | 60 | 543 | 461 | S | O | V5 |
| 18 | 480 | 398 | S | O | V4 | 61 | 545 | 463 | O | T | V5 |
| 19 | 196 | 133 | D | O | V1 | 62 | 831 | 743 | D | O | Kennedy |
| 20 | 542 | 460 | N | K | V5 | 63 | 833 | 745 | S | S | Epitope |
| 21 | 427 | 347 | S | K | | 64 | 926 | 831 | E | E | LLP-1 |
| 22 | 353 | 275 | V | E | Loop D | C: 22 varying contacts | | | | | |
| 23 | 222 | 151 | K | I | V1 | 65 | 190 | 127 | V | V | CD4 |
| 24 | 437 | 356 | O | H | | 66 | 357 | 279 | D | N | Loop D |
| 25 | 558 | 471 | G | G | beta24 | 67 | 358 | 280 | N | N | Loop D |
| 26 | 218 | 147 | M | O | V1 | 68 | 359 | 281 | A | V | Loop D |
| 27 | 727 | 640 | S | E | * | 69 | 360 | 282 | K | K | Loop D |
| 28 | 544 | 462 | N | N | V5 | 70 | 361 | 283 | T | T | Loop D |
| 29 | 216 | 145 | G | A | V1 | 71 | 446 | 365 | G | G | CD4 |
| 30 | 193 | 130 | K | O | | 72 | 450 | 369 | P | L | CD4 |
| 31 | 195 | 132 | T | T | V1 | 73 | 452 | 371 | I | I | CD4 |
| 32 | 707 | 620 | E | G | | 74 | 542 | 460 | N | K | V5 |
| 33 | 4 | 4 | K | M | SignalPep | 75 | 543 | 461 | S | O | V5 |
| 34 | 405 | 325 | N | D | V3 | 76 | 544 | 462 | N | N | V5 |
| 35 | 259 | 185 | D | D | V2 | 77 | 545 | 463 | O | T | V5 |
| 36 | 494 | 412 | D | R | V4 | 78 | 546 | 463+ | - | - | V5 |
| B: 28 signature sites, q<0.1 | | | | | | 79 | 547 | 463+ | - | - | V5 |
| 37 | 193 | 130 | K | O | | 80 | 549 | 463+ | - | - | V5 |
| 38 | 195 | 132 | T | T | V1 | 81 | 549 | 463+ | - | - | V5 |
| 39 | 196 | 133 | D | O | V1 | 82 | 550 | 463+ | - | - | V5 |
| 40 | 198 | 135 | K | T | V1 | 83 | 558 | 471 | G | G | beta24 |
| 41 | 200 | 137 | D | - | V1 | 84 | 559 | 472 | G | G | CD4 |
| 42 | 217 | 146 | R | S | V1 | 85 | 561 | 474 | D | N | CD4 |
| | | | | | | 86 | 563 | 476 | R | K | CD4 |

Fig. 4

Table 2. Ten selected Envs as concatenated sites. Columns follow rows of Table 1. Potentially glycosylated asparagines are shown as "O". Asterisks (*) to the left indicate candidates required for inclusion. Pound signs (#) indicate candidates we recommend be *excluded*. Names of ten clones recommended for inclusion are bold underlined.

```
Column    1    1    2    2    3    3    4    4    5    5    6    6    7    7    8    8
          1    5    0    5    0    5    0    5    0    5    0    5    0    5    0    5
          A: 36 sites with T/F frequency < 20%   B: 28 signature sites, q<0.1   C: 22 varying contacts w000.TF
NVNO---T--HYNTKV-OOKKEIHGOENAOTGMDDR           OTOT-SSOSIOVTENOSKHOTIKOTOSE   VNNVKTSLIKONT-----GGNK M10
.G..................................          ...........................    ...G..................

M11
  DG..................................          ...........................    .D.G..................

M6
# .A..................................          ...........................    ...A..................

w004.03
* ....................................          ...........................    ......................

w004.26
# ....................................          ...........................    ......................

w020.14
# .AOS................................          .....N......KOS.....L......    ...A..................

w030.28
  .DOS......RH........................          .....I........OS...........    ...D..................

w053.16
*DGOSIEIIFTRHSONAETN.E.......G........          ..NO.M......O.OS.E.........    .D.G............E....

w053.31
  DGOSAT.I..RHSON..-DN................          ..D.S.......O.OS......N..K..   .D.G.....N............

w078.7
  DGOSIE.IFTRHSONAE.NEEKLD....G.....G.           ..NOTM...L..O.OS.ED...E.....   .D.G....E.......E....

w078.15
  DGOSATOI..RHSONA.T..EKL.E..D.S......           S........L..O.OS.E..........   .D.G......D......E...

w078.25
#DGOSTAAIFTRHSONAE.D.EK.N.S..S.......            ..D.SO.SI...O.OS.EN......K..   .D.G............E....

w078.33
* .AOSATO.T..HSONA.-DN.......O.NI.T...           NIDOT.......OKOS.....LN.....   ..SA.....N.O..........

w100.A4
  DGOSATO.TDSHSONA....EKLDE.DD.NI.....            NI.......L..O.OS.ED.........  .D.G......D......E...

w100.B4
#DGOSATOI..RHSON...DO.K.DEK.S...D....            ..DOT.NK....O.OS..D...OS.K..  .D.G...P.OSS......E...

w100.B6
*DSOSATO.TN.HSONAO-DE...DEKDT....R...             ..DOT..K....O.OS..D..LENR...  .D.S...P.ENTRDGGNOE...

w100.C7
#DGOSATOITN.HSONAO.DE.K.D.KD.........             ..DOT..K....O.OS..D...EN-...  .D.G...P.EN.-.GGKO....
```

Figure 5

Table 2A. Ten selected Envs as concatenated sites. Columns follow rows of Table 1. Potentially glycosylated asparagines are shown as "O". Asterisks (*) to the left indicate candidates required for inclusion. Pound signs (#) indicate candidates we recommend be *excluded*. Names of ten clones recommended for inclusion are bold underlined.

```
Column     1    1   2    2   3    3   4    4   5    5   6    6   7   7   8   8
           1    5   0    5   0    5   0    5   0    5   0    5   0   5   0   5
           A: 36 sites with T/F frequency < 20% B: 28 signature sites, q<0.1 C: 22 varying contacts w000.TF
NVNO---T--HYNTKV-OOKKEIHGOENAOTGMDDR  KTOT-SSOSIOVTENOSKHOTIKOTOSE  VNNVKTSLIKONT-----GGNK M10
.G.................................  ............................  ..G...................

M11
  DG.................................  ............................  .D.G..................

M6
# .A.................................  ............................  ..A...................

w004.03
* ...................................  ............................  ......................

w004.26
# ...................................  ............................  ......................

w014.12_AG
  ...................................  .........A........NA........  .....P...N.A..........

w014.32_AG
  ...................................  .......................K....  ......................

w020.14
# .AOS...............................  .....N.....KOS......L.......  ..A...................

w030.28
  .DOS......RH.......................  .....I........OS............  ...D..................

w053.16
* DGOSIEIIFTRHSONAETN.E.......G.......  ..NO.M.....O.OS.E...........  .D.G.............E....

w053.31
  DGOSAT.I..RHSON..-DN................  ..D.S........O.OS.......N..K..  .D.G.....N............

w078.7
  DGOSIE.IFTRHSONAE.NEEKLD....G.....G.  ..NOTM...L..O.OS.ED...E.....  .D.G.....E.......E....

w078.15
  DGOSATOI..RHSONA.T..EKL.E..D.S......  S........L..O.OS.E..........  .D.G......D......E...

w078.25
# DGOSTAAIFTRHSONAE.D.EK.N.S...S......  ..D.SO.SI..O.OS.EN.....K....  .D.G.............E....

w078.33
* .AOSATO.T..HSONA.-DN.......O.NI.T...  NIDOT......OKOS.....LN......  ..SA.....N.O..........

w100.A4
  DGOSATO.TDSHSONA....EKLDE.DD.NI.....  NI......L..O.OS.ED..........  .D.G......D......E...

w100.B4
# DGOSATOI..RHSON...DO.K.DEK.S...D....  .DOT.NK....O.OS..D...OS.K...  .D.G...P.OSS......E...

w100.B6
* DSOSATO.TN.HSONAO-DE...DEKDT....R...  ..DOT..K....O.OS..D..LENR...  .D.S...P.ENTRDGGNOE...

w100.C7
# DGOSATOITN.HSONAO.DE.K.D.KD.........  .DOT..K....O.OS..D...EN-....  .D.G...P.EN.-.GGKO....
```

Figure 6

Table 3. Proposed CH505 swarm.
```
1: Prime with T/F and optimal set of Loop D Variants
w000.TF, w004.03,
M10, M11, M19, M20, M21, M5, M6, M7, M8, M9
2: w014.10, w014.2, w014.21, w014.3, w014.32, w014.8
w020.3, w020.4, w020.7, w020.8, w020.9, w020.11, w020.13,
w020.14, w020.15, w020.19, w020.22, w020.23, w020.24, w020.26
3: w030.5, w030.6, w030.9, w030.10, w030.11, w030.13, w030.15,
w030.17, w030.18, w030.19, w030.20, w030.21, w030.23, w030.25,
w030.27, w030.28, w030.36
4: w053.3, w053.6, w053.13, w053.16, w053.25, w053.29, w053.31,
w078.1, w078.6, w078.7, w078.9, w078.10, w078.15, w078.17,
w078.25, w078.33, w078.38
5: w100.A3, w100.A4, w100.A6, w100.A10, w100.A12, w100.A13,
w100.B2, w100.B4, w100.B6, w100.B7, w100.C7,
w136.B2, w136.B3, w136.B4, w136.B5, w136.B8, w136.B10,
w136.B12, w136.B18, w136.B20, w136.B27, w136.B29, w136.B36,
w160.A1, w160.C1, w160.C2, w160.C4, w160.C11, w160.C12,
w160.C14, w160.D1, w160.D5, w160.T2, w160.T4
```

Fig. 7

Table 3A. Proposed CH505 swarm.
```
1: Prime with T/F and optimal set of Loop D Variants
w000.TF, w004.03, w004.26,
M10, M11, M19, M20, M21, M5, M6, M7, M8, M9
2: w014.10, w014.2, w014.21, w014.3, w014.32, w014.8
w020.3, w020.4, w020.7, w020.8, w020.9, w020.11, w020.13,
w020.14, w020.15, w020.19, w020.22, w020.23, w020.24, w020.26
3: w030.5, w030.6, w030.9, w030.10, w030.11, w030.13, w030.15,
w030.17, w030.18, w030.19, w030.20, w030.21, w030.23, w030.25,
w030.27, w030.28, w030.36
4: w053.3, w053.6, w053.13, w053.16, w053.25, w053.29, w053.31,
w078.1, w078.6, w078.7, w078.9, w078.10, w078.15, w078.17,
w078.25, w078.33, w078.38
5: w100.A3, w100.A4, w100.A6, w100.A10, w100.A12, w100.A13,
w100.B2, w100.B4, w100.B6, w100.B7, w100.C7,
w136.B2, w136.B3, w136.B4, w136.B5, w136.B8, w136.B10,
w136.B12, w136.B18, w136.B20, w136.B27, w136.B29, w136.B36,
w160.A1, w160.C1, w160.C2, w160.C4, w160.C11, w160.C12,
w160.C14, w160.D1, w160.D5, w160.T2, w160.T4
```

Fig. 8

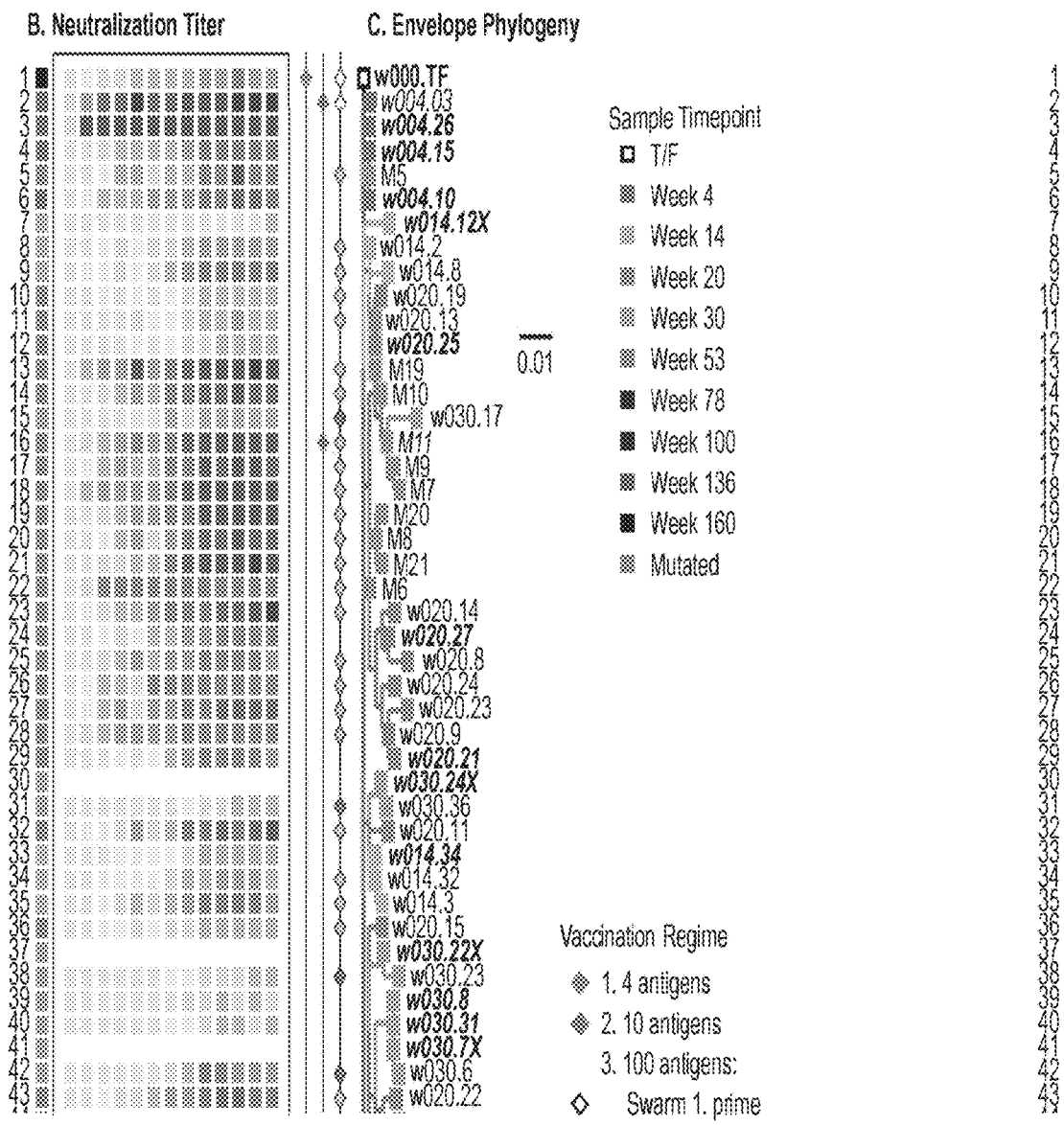
Figures 13B and C

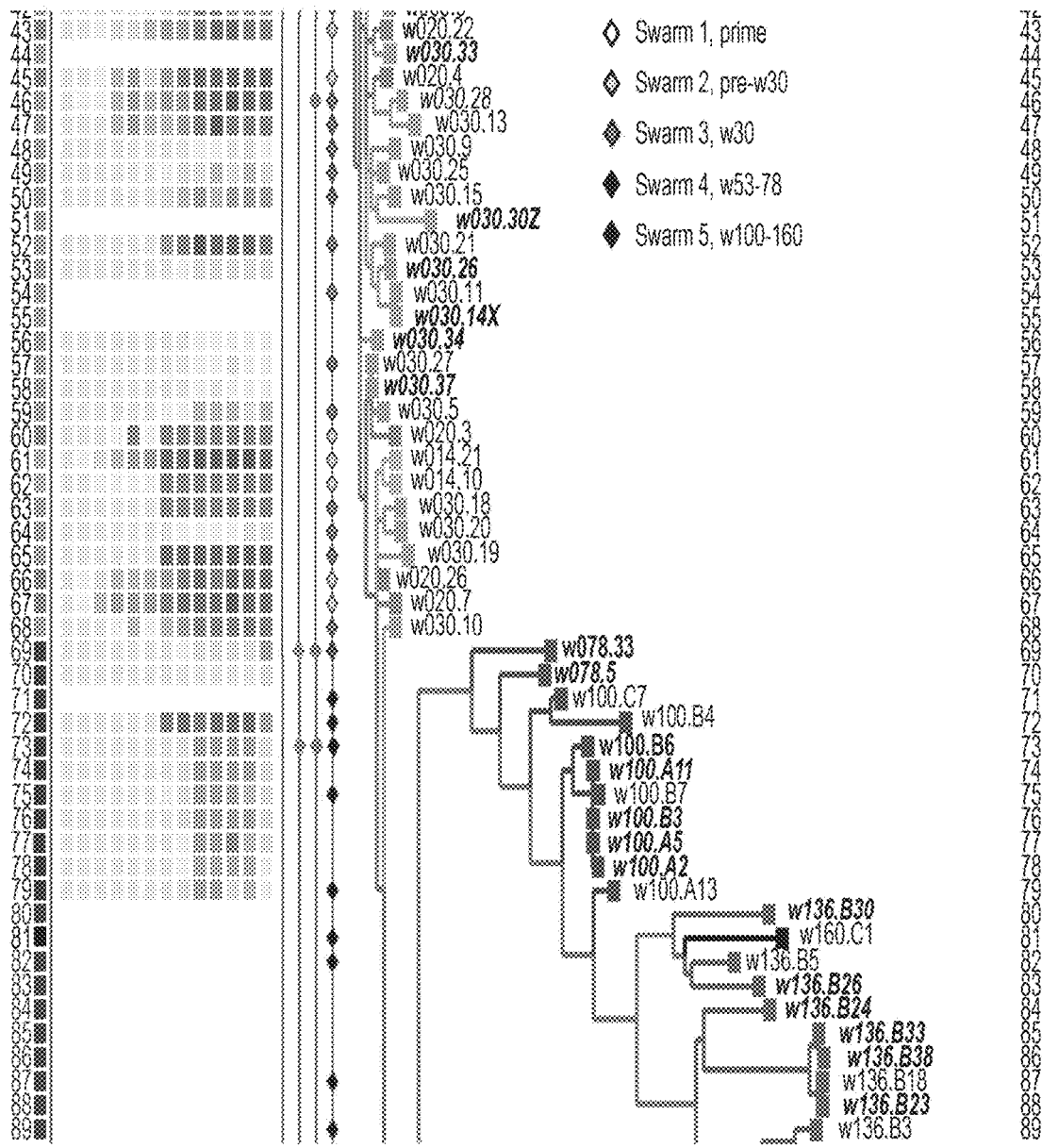
Figures 13B and C (cont.)

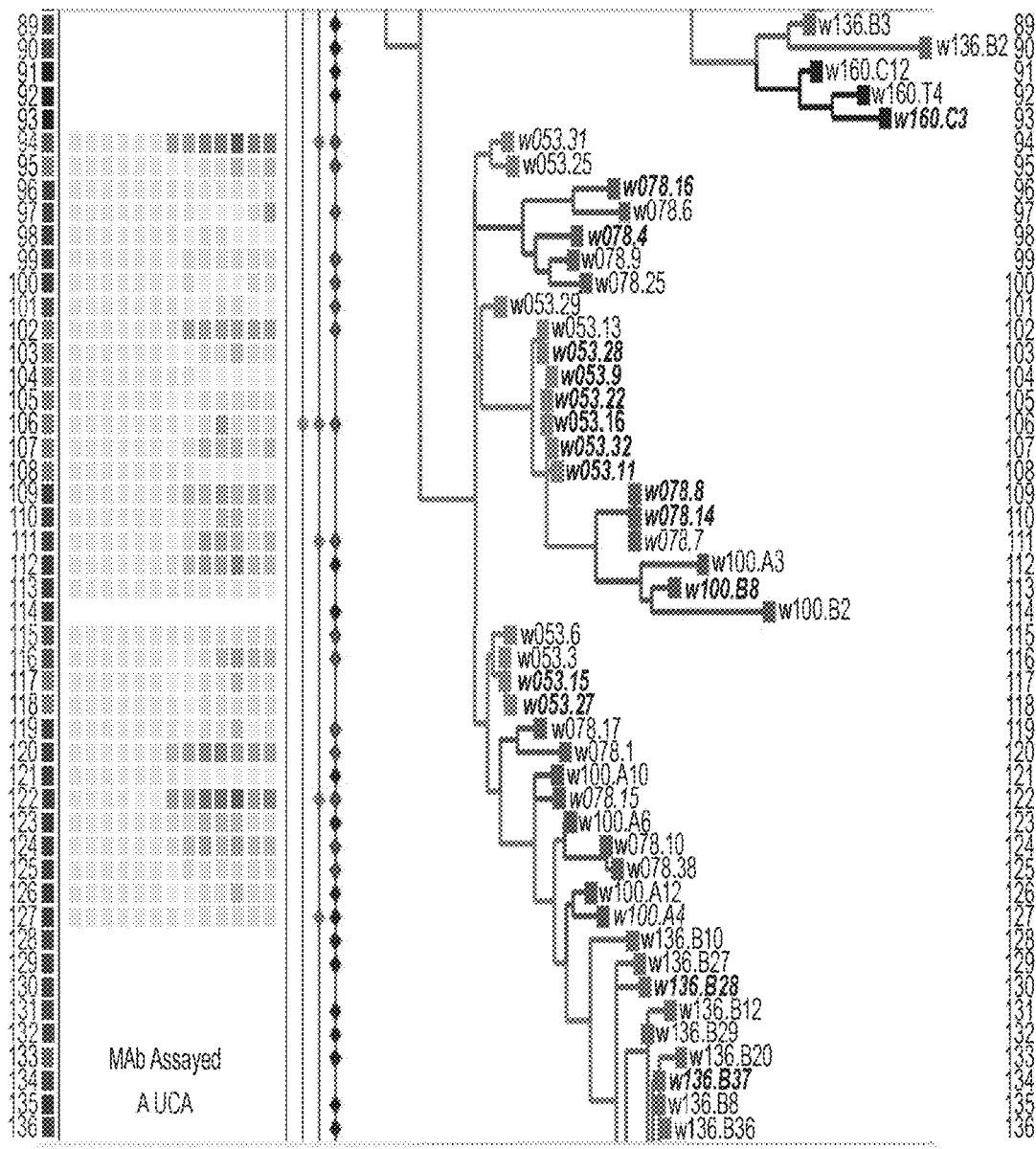
Figures 13B and C (cont.)

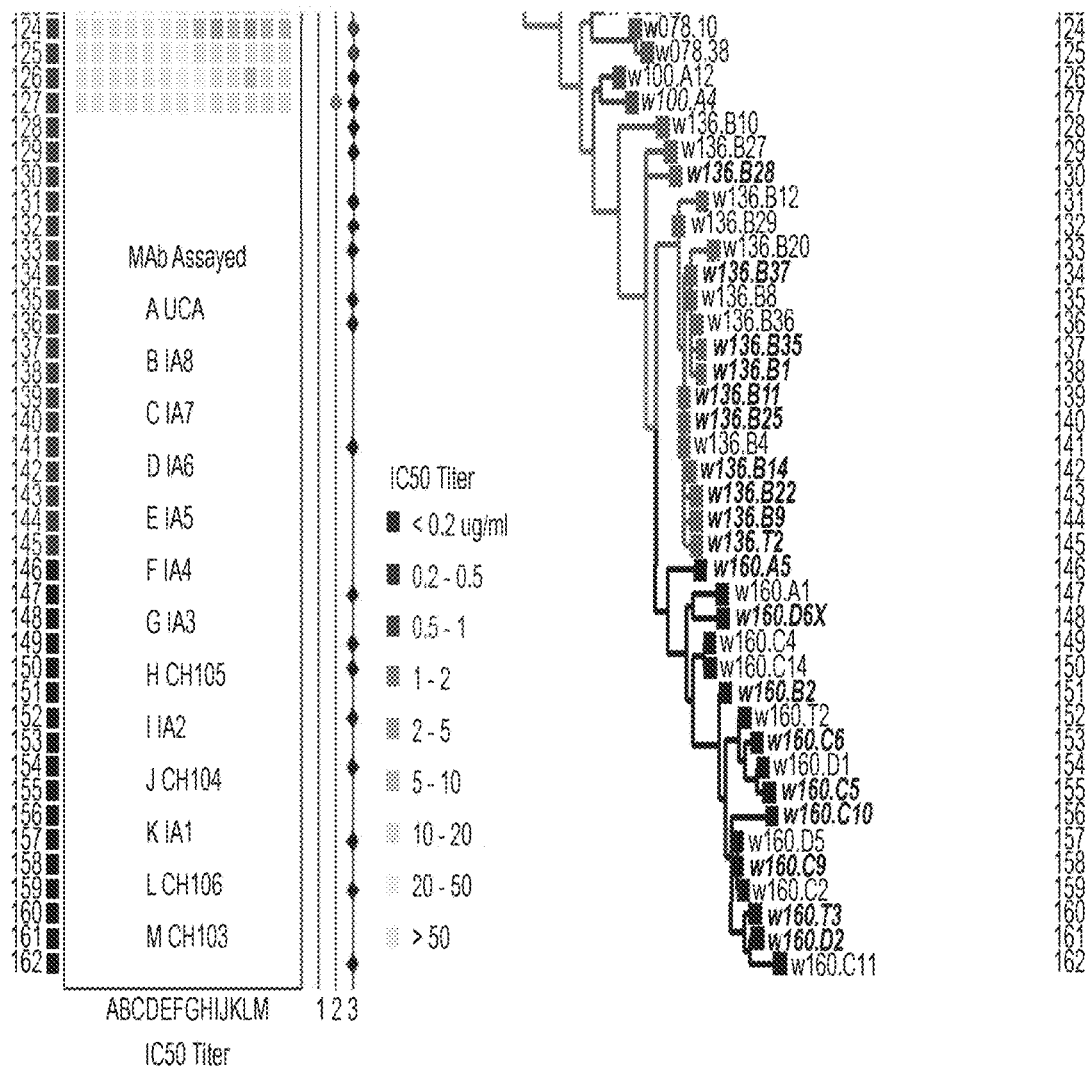
Figures 13B and C (cont.)

Fig. 14A
>CH0505.TF
TGGAAGGGTTAGTTTACTCCAAGAAAAGACAAGAGATCCTTGATTTGTGG
GTCTATAACACACAAGGCTTCTTCCCTGATTGGCAAAACTACACACCGGG
ACCAGGGGTCAGATATCCACTGACCTTTGGATGGTGCTTCAAGCTAGTGC
CAGTCGATCCAGAGGAAGTAGAAGAGGCCAATAAAGGAGAAAACAACTGC
TTACTACACCCTATGAGCCAGCATGGAATGGATGATGAGGACAGAGAAGT
ACTAAAGTGGAAGTTTGACAGTCAGCTAGCACGCAGACACATGGCCCGCG
AGCTACATCCGGAGTGGTACAAAGACTGCTGACACAGAAGGGACTTTCCG
CTGGGACTTTCCACTGGGGCGTTCCAGGGGGAGTGGTCTGGGCGGGACTG
GGAGTGGCCAACCCTCAGATGCTGCATATAAGCAGCTGCTTTTCGCCTGT
ACTGGGTCTCTCTAGGTAGACCAGATCTGAGCCCGGGAGCTCTCTGACTA
CCTAGGGAACCCACTGCTTAAGCCTCAATAAAAGCTTGCCTTGAGTGCTC
TAAGTAGTGTGTGCCCGTCTGTTGTGTGACTCTGGTAACTAGAGATCCCT
CAGACCCTTTGTGGTAGTGTGGAAAATCTCTAGCAGTGGCGCCCGAACAG
GGACTTGAAAGCGAAAGTAGAACCAGAGGAGATCTCTCGACGCAGGACTC
GGCTTGCTGAAGTGCACTCGGCAAGAGGCGAGAGCGGCGGCTGGTGAGTA
CGCCAAATTTTATTTGACTAGCGGAGGCTAGAAGGAGAGAGATGGGTGCG
AGAGCGTCAATATTAAGAGGGGGAAAATTAGATAAATGGGAAAGAATTAG
GTTAAGGCCAGGGGGAAAGAAATGCTATATGATAAAACACTTAGTATGGG
CAAGCAGGGAGTTGGAAAGATTTGCACTTAATCCTGGCCTCTTAGAAACA
TCAGAAGGCTGTAGACAAATAATAAAGCAGCTACAACCATCTCTTCAGAC
AGGAACAGAGGAACTTAGATCATTATATAACACAGTAGTAACTCTCTATT
GTGTACATGAAGAGATAGAAGTACGAGACACCAAAGAAGCCTTAGACAAA
CTAGAGGAAGAACAAAACAAATGTCAGCAAAAAGCACAGCAAGCAGAGGC
GGCTGACAAAGGAAAGGTCAGCCAAAATTATCCTATAGTACAGAATCTCC
AAGGGCAAATGGTACACCAGCCCCTATCACCTAGAACTTTGAATGCATGG
GTGAAAGTAATAGAAGAGAAGGGTTTTAACCCAGAGGTAATACCCATGTT
TTCAGCATTATCAGAAGGAGCCACCCCACAAGACTTAAACACCATGTTAA
ATACAGTAGGGGACATCAAGCAGCCATGCAAATGTTGAAAGATACCATC
AATGAGGAGGCTGCAGAATGGGATAGATTACATCCAGTCCATGCAGGGCC
TATTGCACCAGGCCAAATGAGAGAACCAAGGGGAAGTGATATAGCAGGAA
CAACTAGCAACCTTCAGGAACAAATAGCATGGATGACAGCTAACCCACCT
ATCCCAGTGGGAGAATTGTATAAAAGATGGATAATTCTGGGATTAAATAA
AATAGTAAGAATGTATAGCCCTGTCAGCATTTTGGACATAAAACAAGGGC
CAAAAGAACCCTTTAGAGACTATGTAGACCGGTTCTTTAAAACTTTGAGA
GCTGAACAAGCTACACAAGATGTAAAAAATTGGATGACAGACACCTTGTT
GACCCAAAATGCGAACCCAGATTGTAAGACCATTTTAAGAGCATTAGGAC
CAGGGGCTACATTAGAAGAAATGATGACAGCATGCCAAGGAGTGGGAGGA
CCTAGCCACAAAGCAAGAGTGCTAGCTGAAGCAATGAGCCAAGTAAATCA
TCCAAACATAATGATGCAGAGAAACAATTTTAAAGGACCAAAAAGAATTG
TTAAATGCTTCAACTGTGGCAAGGAAGGGCACATAGCCAGAAATTGCAGG
GCACCTAGGAAAAGGGGCTGTTGGAAATGTGGAAAGGAAGGACACCAAAT
GAAAGACTGTACTGAAAGGCAGGCTAATTTTTTAGGGAAAATTTGGCCTT
CCCACAAGGGGAGGCCAGGGAATTTCATCCAGAACAGGCTAGAGCCCACA
GCCCCACCAGCAGAGAGTTTCAGGTTCGAGGAGACAACCCCCAGTCTGAA
GCAGGAGCCGAAGGAGAGGGAACCACCCTTAACTTCCCTCAAATCACTCT
TTGGCAGCGACCCCTTGTCTCAATAAGAGTAGGGGGCCAGATAAAGGAGG
CTCTCTTAGACACAGGAGCAGATGATACAGTATTAGAAGAAATAAATTTG
CCAGGGAAATGGAAACCAAAAATGATAGGAGGAATTGGAGGCTTTATCAA
AGTAAGACAGTATGATCAAATATCTATAGAAATTTGTGGAAAAAAGGCTA
TAGGTACAGTATTAGTGGGACCTACACCTGTCAACATAATTGGAAGGAAT

Fig. 14A (cont.)

```
CTGTTGACTCAGCTTGGATGTACATTAAATTTTCCAATTAGTCCCATTGA
AACTGTACCAGTAAAATTAAAGCCAGGAATGGATGGCCCAAAAGTTAAAC
AATGGCCATTGACAGAAGAGAAATAAAAGCATTAACAGCAATCTGTGAA
GACATGGAGAAGGAAGGAAAAATTTCAAAAATTGGGCCTGAAAATCCATA
TAACACTCCAGTATTTGCCATAAAAAAGAAGGACAGTACAAAGTGGAGAA
AATTAGTAGATTTCAGGGAACTCAACAAGAGAACTCAAGACTTCTGGGAA
GTTCAACTAGGAATACCACACCCAGCAGGGTTAAAAAAGAAAAAATCAGT
GACAGTACTAGATGTGGGGGATGCATATTTTTCAGTACCTTTAGATGAAG
GCTTCAGGAAATATACTGCGTTCACCATACCTAGTATAAACAATGAAACA
CCAGGGATTAGATATCAATATAATGTGCTTCCACAGGGATGGAAAGGATC
ACCAGCAATATTCCAGAGTAGCATGACAAAAATCTTAGAGCCCTTTAGGA
TAAAAAATCCAGACATAGTTATCTATCAATATATGGATGACTTGTATGTA
GGATCTGACTTAGAATTAGGACAGCATAGAGCAAAAATAGAAGAGCTAAG
GGAACATTTATTAAAATGGGGACTTACCACACCAGACAAGAAACATCAAA
AAGAACCCCCATTTCTTTGGATGGGGTATGAACTCCATCCTGACAAATGG
ACAGTACAGCCTATAAAGCTGCCAGACAAGGAAAGCTGGACTGTCAATGA
TATACAAAAGTTAGTAGGAAAATTAAACTGGGCAAGTCAGATTTACCCAG
GGATTAAAGTAAGGCAACTCTGTAAACTCCTTAGGGGGGCCAAAGCACTA
ACAGACATAGTACCACTAACTGAAGAAGCAGAATTAGAATTGGCAGAGAA
CAGGGAAATTCTAAAAGAACCAGTACATGGAGTATATTATGACCCTGCTA
AAGAATTAATAGCTGAAATACAGAAGCAGGGGCATGACCAATGGACATAC
CAAATTTACCAAGAACCATTCAAAAATCTGAAAACAGGAAAGTATGCAAA
AATGAGGGCTGCCCATACCAATGATGTAAAGCAATTAACAGAGGCAGTGC
AAAAAATAGCTACAGAAAGCATAGTAATATGGGGAAAGACCCCTAAGTTT
AGATTACCCATCCAAAAAGAAACATGGGAGACATGGTGGACAGACTATTG
GCAGGCTACCTGGATTCCTGAGTGGGAGTATGTTAATACTCCTCCCCTAG
TAAAATTATGGTACCAACTGGAAAAAGAACCCATAGTAGGAGTAGAAACT
TTCTATGTAGATGGAGCAGCTAATAGGGAAACTAAGTTAGGAAAAGCAGG
GTATGTTACTGACAGGGGAAGGCAGAAAGTCGTTTCCCTAACTGAAACAA
CAAATCAGAAGGCTGAGTTACAAGCAATTCAGTTAGCTTTGCAGGATTCA
GGATCAGAAGTAAACATAGTAACAGACTCACAGTATGCATTAGGAATCAT
TCAAGCACAACCAGATAAGAGTGAATCAGGGTTAGTTAACCAAATAATAG
AACAGTTAATAAACAAGGAAAGAATCTACCTGTCATGGGTACCAGCACAT
AAGGGAATTGGAGGGAATGAACAAGTGGACAAATTAGTAAGTAAGGGGAT
CAGGAAAGTGCTGTTTCTAGATGGAATAGAGAAGGCTCAAGAAGAGCATG
AAAGATATCACAACAATTGGAGAGCAATGGCTAGTGAGTTTAATCTGCCA
CCCATAGTAGCAAAAGAAATAGTAGCTAGCTGTGATAAATGTCAGTTAAA
AGGGGAAGCCATACATGGACAAGTAGACTGTAGTCCAGGGATATGGCAAT
TAGACTGCACACATTTAGAAGGAAAAACTATCTTGGTAGCAGTCCATGTA
GCCAGTGGCTACATAGAAGCAGAGGTCATTCCAGCAGAAACAGGACAAGA
AACAGCATACTATATACTAAAATTAGCAGGAAGATGGCCAGTCAAAATGA
TACATACAGACAATGGCAGTAATTTCACCAGTGCTGCAGTTAAGGCAGCC
TGTTGGTGGGCGGGTATCCAACAGGAATTTGGAATTCCCTACAATCCCCA
AAGTCAGGGAGTAGTAGAATCCATGAATAAAGAATTAAAGAAAATCATAG
GGCAAGTAAGAGATCAAGCTGAGCACCTTAAGACAGCAGTACAAATGGCA
GTATTCATTCACAATTTTAAAAGAAAAGGGGGGATTGGGGGGTACAGTGC
AGGGGAAAGAATAATAGACATGATAGCAACAGACATACAAACTAAAGAAT
TACAAAAACAAATTATAAAAATTCAAAATTTTCGGGTTTATTACAGAGAC
AGCAGAGATCCTATTTGGAAAGGACCAGCCAAACTACTCTGGAAAGGTGA
AGGGGCAGTAGTCATACAAGATAACAGTGACATAAAGGTAGTACCAAGAA
GGAAAGTAAAAATCATTAGGGACTATGGAAAACAGATGGCAGGTGCTGAT
TGTGTGGCAGGTAGACAGGATGAGGATTAGAACATGGCACAGTTTAGTAA
AGCACCACATGTATGTCTCAAGGAGAGCTAGTGGATGGTTCTACAGACCT
CATTATGCAAGTAGACATCCAAAAATAAGTTCAGAGGTACACATCCCATT
```

Fig. 14A (cont.)

```
AGGGGAGGCTAGATTAGTAATAACAACATATTGGGGTTTGCAAACAGGAG
AAAGAGAGTGGCACTTAGGTAATGGAGCCTCCATAGAATGGAGAATGAGA
AAATATAGCACACAAATAGATCCTGGCCTGGCAGACCAGCTAATTCATAT
GCATTATTTTGATTGTTTTGCAGACTCTGCCATAAGAAAAGCCATATTAG
GACATATAGTTATCCCTAGGTGTGACTATCAAGCAGGACATAATAAGGTA
GGATCTCTTCAATACTTGGCACTGACAGCATTGATAAAACCAAAAAGAG
AAAGCCACCTCTGCCTAGTGTTAAGAAATTAGTAGAGGATAGATGGAACA
ACCCCCAGAAGACCAGGGGCCGCAGAGGGAACCATATAACGAGTGGACAC
TAGAACTCTTAGAGGAACTCAAGCAGGAAGCTGTCAGACACTTTCCTAGA
CCATGGCTCCATGCATTAGGACAACATATCTATGATACCTATGGGGATAC
TTGGACAGGAGTTGAAGCTATAATAAGAATACTTCAACAGTTACTGTTTA
CTCATTTCAGAATTGGGTGCCAACATAGCAGAATAGGCATTCTGCGACAG
AGAAGAGCAAGAAATGGAGCCAGTAGACCCTAACCTAGAGCCCTGGAATC
ATCCAGGAAGTCAGCCCAAAACTCCTTGTAATAAGTGTTATTGTAAGCGA
TGCTGCTATCATTGTCTAGTTTGCTTTCAGACAAAAGGCTTAGGCATTTC
CCATGGCAGGAAGAAGCGGAGACAGCGACGAAGCGCTCCTCCAAGCAGTG
AGAATCATCAAAATCCTTTATCAAAGCAGTGAGTATTCAATAAGCATATG
TAATGTTTGATTTATATGCAAGAGTAGATTATAGAATAGGAGTAGGAGCA
TTGGCAATAGCACTAATCATAGCAATAATAGTGTGGACCATAGTATATAT
AGAATATAGGAAATTAGTAAGACAAAGAAAAATAGACCAGTTAATTAAAA
GAATTAGGGAAAGAGCAGAAGACAGTGGCAATGAGAGTGATGGGGATACA
GAGGAATTATCCACAATGGTGGATATGGAGCATGTTAGGCTTTTGGATGC
TAATGATTTGTAATGGGATGTGGGTCACAGTCTACTATGGGGTACCTGTG
TGGAAAGAAGCAAAAACTACTCTATTTTGTGCATCAGATGCTAAAGCATA
TGAGAAAGAAGTGCATAATGTCTGGGCTACACATGCCTGTGTACCCACAG
ACCCCAATCCACAAGAAATGGTTTTAAAAAATGTAACAGAAAATTTCAAC
ATGTGGAAAAATGACATGGTGGATCAGATGCATGAAGATGTAATTAGTTT
ATGGGATCAAAGCCTCAAGCCATGTGTAAAGTTGACCCCACTCTGTGTCA
CTCTAAACTGTACCAATGCTACTGCCAGCAATAGCAGTATAATAGAGGGA
ATGAAAAATTGCTCTTTCAATATAACCACAGAATTAAGAGATAAGAGAGA
GAAAAAGAATGCACTTTTTTATAAACTTGATATAGTACAACTAGATGGCA
ACTCTAGTCAGTATAGATTAATAAATTGTAATACCTCAGTCATAACACAA
GCCTGTCCAAAGGTCTCTTTTGACCCAATTCCTATACATTATTGTGCTCC
AGCTGGTTATGCGATTCTAAAGTGTAATAATAAGACATTCACTGGAACAG
GACCGTGTAATAATGTCAGCACAGTACAATGTACACATGGAATTAAGCCA
GTGGTTTCAACTCAACTATTGTTAAATGGTAGCCTAGCAGAAGGAGAGAT
AATAATTAGATCTGAAAATATAACAAACAATGTCAAAACAATAATAGTAC
ATCTCAATGAATCTGTAAAGATTGAGTGTACGAGACCCAATAATAAAACA
AGAACAAGTATAAGAATAGGACCAGGACAAGCATTTATGCAACAGGACA
AGTAATAGGAGACATAAGAGAAGCATATTGTAACATTAATGAAAGTAAAT
GGAATGAAACTTTACAAAGGGTAAGTAAAAAATTAAAAGAATACTTCCCT
CATAAGAATATAACATTTCAACCATCCTCAGGAGGGGACCTAGAAATTAC
AACACATAGCTTTAATTGTGGAGGAGAATTTTTCTATTGCAATACATCAA
GCCTGTTTAATAGGACATATATGGCTAATAGTACAGATATGGCTAATAGT
ACAGAAACTAACAGTACACGAACCATCACAATCCACTGCAGAATAAAACA
AATTATAAACATGTGGCAGGAGGTGGGACGAGCAATGTATGCCCCTCCCA
TTGCAGGAAACATAACATGTATATCAAATATCACAGGACTACTATTGACA
AGGGATGGAGGAAAAACAATACGGAGACATTCAGACCTGGAGGAGGAAA
TATGAAGGACAATTGGAGAAGTGAATTATATAAATATAAAGTGGTAGAAG
TTAAGCCATTAGGAGTAGCACCCACTAATGCAAGAAGGAGAGTGGTGGAG
AGAGAAAAAGAGCAGTGGGAATGGGAGCTGTGTTCCTTGGGTTCTTGGG
AGCGGCAGGAAGCACTATGGGCGCAGCATCAATAACGCTGACGGTACAGG
CCAGACAATTATTGTCTGGTATAGTGCAACAGCAAAGCAATTTGCTGAAG
GCTATAGAGGCTCAACAGCATATGTTGAAACTCACGGTCTGGGGCATTAA
```

Fig. 14A (cont.)

```
ACAGCTCCAGGCAAGAGTCCTGGCCTTGGAAAGATACCTAAAGGATCAAC
AGCTCCTAGGGATGTGGGGCTGCTCTGGAAAACTCATCTGCACCACTAAT
GTATATTGGAACTCTAGTTGGAGTAATAAAACTTATGGTGATATTTGGGA
TAACATGACCTGGATGCAGTGGGAGAGAGAAATTAGCAATTATACAGAAA
TAATATATGAATTGCTTGAAGAATCACAAAACCAGCAGGAAAAGAATGAA
CAAGATTTACTAGCATTGGACAGATGGAACAGTCTGTGGAATTGGTTTAA
CATAACAAATTGGCTGTGGTATATAAAAATATTCATAATGATAGTAGGAG
GCTTGATAGGTTTAAGAATAATTTTTGCTGTGCTTTCTTTAGTAAATAGA
GTTAGGCAGGGATACTCACCTCTGTCGTTGCAGACCCTTATCCCAAGCCC
GAGGGGACCAGACAGGCCCGGAGGAATCGAAGAAGAAGGTGGAGAGCAAG
ACAGAAACAGATCAACGCGATTAGTGAGCGGATTCTTAGCGCTTGTCTGG
GACGACCTGCGGAGCCTGTGCCTTTTCATCTACCACCGATTGAGAGACTT
CATATTAATTGCAGCGAGAGCGGGGGAACTTCTGGGACGCAGCAGTCTCA
AGGGACTACGGAGAGGATGGGAAGCCCTTAAGTATCTGGGAAGTCTTGTG
CAGTATTGGGGCCTGGAACTAAAAAGGAGTGCTATTAGTCTATTGGATAC
CCTAGCAATAGCAGTAGGTGAAGGAACAGATAGGATTCTAGAATTTGTAT
TAGGAATTTGTAGAGCTATCCGCAACATACCTACAAGAATAAGACAGGGC
TTTGAAACAGCTTTGCTATAAAATGGGGGGCAAGTGGTCAAAAAGCAGTA
TAGTTGGATGGCCTGATGTAAGAGAAAGAATAAGAAGAACTGATCCAGCA
GCAGAGGGAGTAGGAGCAGCATCTCAAGACTTAGATAGACATGGGGCACT
TACAATTAACAACACAGCCGCCAATAATGCTGATTGTGCCTGGCTGGAGG
CACAAGAGGAGGAGGGAGAAGTAGGCTTTCCAGTCAGACCTCAGGTACCT
TTAAGACCAATGACTTATAAGGAAGCATTCGACCTCAGCTTCTTTTTAAA
AGAAAAGGGGGACTGGAAGGGTTAGTTTACTCCAAGAAAAGACAAGAGA
TCCTTGATTTGTGGGTCTATAACACACAAGGCTTCTTCCCTGATTGGCAA
AACTACACACCGGGACCAGGGGTCAGATATCCACTGACCTTTGGATGGTG
CTTCAAGCTAGTGCCAGTCGATCCAGAGGAAGTAGAAGAGGCCAATAAAG
GAGAAAACAACTGCTTACTACACCCTATGAGCCAGCATGGAATGGATGAT
GAGGACAGAGAAGTACTAAAGTGGAAGTTTGACAGTCAGCTAGCACGCAG
ACACATGGCCCGCGAGCTACATCCGGAGTGGTACAAAGACTGCTGACACA
GAAGGGACTTTCCGCTGGGACTTTCCACTGGGGCGTTCCAGGGGGAGTGG
TCTGGGCGGGACTGGGAGTGGCCAACCCTCAGATGCTGCATATAAGCAGC
TGCTTTTCGCCTGTACTGGGTCTCTCTAGGTAGACCAGATCTGAGCCCGG
GAGCTCTCTGACTACCTAGGGAACCCACTGCTTAAGCCTCAATAAAAGCT
TGCCTTGAGTGCTCTAAGTAGTGTGTGCCCGTCTGTTGTGTGACTCTGGT
AACTAGAGATCCCTCAGACCCTTTGTGGTAGTGTGGAAAATCTCTAGCA
```

Fig. 14B (CH0505 gene sequences)

GAG

ATGGGTGCGAGAGCGTCAATATTAAGAGGGGGAAAATTAGATAAATGGGAAAGAATTAGGTTAAGGCCAG
GGGGAAAGAAATGCTATATGATAAAACACTTAGTATGGGCAAGCAGGGAGTTGGAAAGATTTGCACTTAA
TCCTGGCCTCTTAGAAACATCAGAAGGCTGTAGACAAATAATAAAGCAGCTACAACCATCTCTTCAGACA
GGAACAGAGGAACTTAGATCATTATATAACACAGTAGTAACTCTCTATTGTGTACATGAAGAGATAGAAG
TACGAGACACCAAAGAAGCCTTAGACAAACTAGAGGAAGAACAAAACAAATGTCAGCAAAAAGCACAGCA
AGCAGAGGCGGCTGACAAAGGAAAGGTCAGCCAAAATTATCCTATAGTACAGAATCTCCAAGGGCAAATG
GTACACCAGCCCCTATCACCTAGAACTTTGAATGCATGGGTGAAAGTAATAGAAGAGAAGGGTTTTAACC
CAGAGGTAATACCCATGTTTTCAGCATTATCAGAAGGAGCCACCCCACAAGACTTAAACACCATGTTAAA
TACAGTAGGGGACATCAAGCAGCCATGCAAATGTTGAAAGATACCATCAATGAGGAGGCTGCAGAATGG
GATAGATTACATCCAGTCCATGCAGGGCCTATTGCACCAGGCCAAATGAGAGAACCAAGGGGAAGTGATA
TAGCAGGAACAACTAGCAACCTTCAGGAACAAATAGCATGGATGACAGCTAACCCACCTATCCCAGTGGG
AGAATTGTATAAAAGATGGATAATTCTGGGATTAAATAAAATAGTAAGAATGTATAGCCCTGTCAGCATT
TTGGACATAAAACAAGGGCCAAAAGAACCCTTTAGAGACTATGTAGACCGGTTCTTTAAAACTTTGAGAG
CTGAACAAGCTACACAAGATGTAAAAAATTGGATGACAGACACCTTGTTGACCCAAAATGCGAACCCAGA
TTGTAAGACCATTTTAAGAGCATTAGGACCAGGGCTACATTAGAAGAAATGATGACAGCATGCCAAGGA
GTGGGAGGACCTAGCCACAAAGCAAGAGTGCTAGCTGAAGCAATGAGCCAAGTAAATCATCCAAACATAA
TGATGCAGAGAAACAATTTTAAAGGACCAAAAAGAATTGTTAAATGCTTCAACTGTGGCAAGGAAGGGCA
CATAGCCAGAAATTGCAGGGCACCTAGGAAAAGGGGCTGTTGGAAATGTGGAAAGGAAGGACACCAAATG
AAAGACTGTACTGAAAGGCAGGCTAATTTTTTAGGGAAAATTTGGCCTTCCCACAAGGGGAGGCCAGGGA
ATTTCATCCAGAACAGGCTAGAGCCCACAGCCCCACCAGCAGAGAGTTTCAGGTTCGAGGAGACAACCCC
CAGTCTGAAGCAGGAGCCGAAGGAGAGGGAACCACCCTTAACTTCCCTCAAATCACTCTTTGGCAGCGAC
CCCTTGTCTCAATAA

Fig. 14B (cont.)

POL

TTTTTTAGGGAAAATTTGGCCTTCCCACAAGGGGAGGCCAGGGAATTTCATCCAGAACAGGCTAGAGCCC
ACAGCCCCACCAGCAGAGAGTTTCAGGTTCGAGGAGACAACCCCCAGTCTGAAGCAGGAGCCGAAGGAGA
GGGAACCACCCTTAACTTCCCTCAAATCACTCTTTGGCAGCGACCCCTTGTCTCAATAAGAGTAGGGGGC
CAGATAAAGGAGGCTCTCTTAGACACAGGAGCAGATGATACAGTATTAGAAGAAATAAATTTGCCAGGGA
AATGGAAACCAAAAATGATAGGAGGAATTGGAGGCTTTATCAAAGTAAGACAGTATGATCAAATATCTAT
AGAAATTTGTGGAAAAAAGGCTATAGGTACAGTATTAGTGGGACCTACACCTGTCAACATAATTGGAAGG
AATCTGTTGACTCAGCTTGGATGTACATTAAATTTTCCAATTAGTCCCATTGAAACTGTACCAGTAAAAT
TAAAGCCAGGAATGGATGGCCCAAAAGTTAAACAATGGCCATTGACAGAAGAGAAAATAAAAGCATTAAC
AGCAATCTGTGAAGACATGGAGAAGGAAGGAAAAATTTCAAAAATTGGGCCTGAAAATCCATATAACACT
CCAGTATTTGCCATAAAAAAGAAGGACAGTACAAAGTGGAGAAAATTAGTAGATTTCAGGGAACTCAACA
AGAGAACTCAAGACTTCTGGGAAGTTCAACTAGGAATACCACACCCAGCAGGGTTAAAAAAGAAAAAATC
AGTGACAGTACTAGATGTGGGGGATGCATATTTTTCAGTACCTTTAGATGAAGGCTTCAGGAAATATACT
GCGTTCACCATACCTAGTATAAACAATGAAACACCAGGGATTAGATATCAATATAATGTGCTTCCACAGG
GATGGAAAGGATCACCAGCAATATTCCAGAGTAGCATGACAAAAATCTTAGAGCCCTTTAGGATAAAAAA
TCCAGACATAGTTATCTATCAATATATGGATGACTTGTATGTAGGATCTGACTTAGAATTAGGACAGCAT
AGAGCAAAAATAGAAGAGCTAAGGGAACATTTATTAAAATGGGGACTTACCACACCAGACAAGAAACATC
AAAAAGAACCCCCATTTCTTTGGATGGGGTATGAACTCCATCCTGACAAATGGACAGTACAGCCTATAAA
GCTGCCAGACAAGGAAAGCTGGACTGTCAATGATATACAAAAGTTAGTAGGAAAATTAAACTGGGCAAGT
CAGATTTACCCAGGGATTAAAGTAAGGCAACTCTGTAAACTCCTTAGGGGGGCCAAAGCACTAACAGACA
TAGTACCACTAACTGAAGAAGCAGAATTAGAATTGGCAGAGAACAGGGAAATTCTAAAAGAACCAGTACA
TGGAGTATATTATGACCCTGCTAAAGAATTAATAGCTGAAATACAGAAGCAGGGCATGACCAATGGACA
TACCAAATTTACCAAGAACCATTCAAAAATCTGAAAACAGGAAAGTATGCAAAAATGAGGGCTGCCCATA
CCAATGATGTAAAGCAATTAACAGAGGCAGTGCAAAAAATAGCTACAGAAAGCATAGTAATATGGGGAAA
GACCCCTAAGTTTAGATTACCCATCCAAAAAGAAACATGGGAGACATGGTGGACAGACTATTGGCAGGCT
ACCTGGATTCCTGAGTGGGAGTATGTTAATACTCCTCCCCTAGTAAAATTATGGTACCAACTGGAAAAAG
AACCCATAGTAGGAGTAGAAACTTTCTATGTAGATGGAGCAGCTAATAGGGAAACTAAGTTAGGAAAAGC
AGGGTATGTTACTGACAGGGGAAGGCAGAAAGTCGTTTCCCTAACTGAAACAACAAATCAGAAGGCTGAG
TTACAAGCAATTCAGTTAGCTTTGCAGGATTCAGGATCAGAAGTAAACATAGTAACAGACTCACAGTATG
CATTAGGAATCATTCAAGCACAACCAGATAAGAGTGAATCAGGGTTAGTTAACCAAATAATAGAACAGTT
AATAAACAAGGAAAGAATCTACCTGTCATGGGTACCAGCACATAAGGGAATTGGAGGGAATGAACAAGTG
GACAAATTAGTAAGTAAGGGGATCAGGAAAGTGCTGTTTCTAGATGGAATAGAGAAGGCTCAAGAAGAGC
ATGAAAGATATCACAACAATTGGAGAGCAATGGCTAGTGAGTTTAATCTGCCACCCATAGTAGCAAAAGA
AATAGTAGCTAGCTGTGATAAATGTCAGTTAAAAGGGGAAGCCATACATGGACAAGTAGACTGTAGTCCA
GGGATATGGCAATTAGACTGCACACATTTAGAAGGAAAAACTATCTTGGTAGCAGTCCATGTAGCCAGTG
GCTACATAGAAGCAGAGGTCATTCCAGCAGAAACAGGACAAGAAACAGCATACTATATACTAAAATTAGC
AGGAAGATGGCCAGTCAAAATGATACATACAGACAATGGCAGTAATTTCACCAGTGCTGCAGTTAAGGCA
GCCTGTTGGTGGCGGGTATCCAACAGGAATTTGGAATTCCCTACAATCCCCAAAGTCAGGGAGTAGTAG
AATCCATGAATAAAGAATTAAAGAAAATCATAGGGCAAGTAAGAGATCAAGCTGAGCACCTTAAGACAGC
AGTACAAATGGCAGTATTCATTCACAATTTTAAAAGAAAAGGGGGGATTGGGGGGTACAGTGCAGGGGAA
AGAATAATAGACATGATAGCAACAGACATACAAACTAAAGAATTACAAAAACAAATTATAAAAATTCAAA
ATTTTCGGGTTTATTACAGAGACAGCAGAGATCCTATTTGGAAAGGACCAGCCAAACTACTCTGGAAAGG
TGAAGGGGCAGTAGTCATACAAGATAACAGTGACATAAAGGTAGTACCAAGAAGGAAAGTAAAAATCATT
AGGGACTATGGAAAACAGATGGCAGGTGCTGATTGTGTGGCAGGTAGACAGGATGAGGATTAG

Fig. 14B (cont.)

VIF

ATGGAAAACAGATGGCAGGTGCTGATTGTGTGGCAGGTAGACAGGATGAGGATTAGAACATGGCACAGTT
TAGTAAAGCACCACATGTATGTCTCAAGGAGAGCTAGTGGATGGTTCTACAGACCTCATTATGCAAGTAG
ACATCCAAAAATAAGTTCAGAGGTACACATCCCATTAGGGGAGGCTAGATTAGTAATAACAACATATTGG
GGTTTGCAAACAGGAGAAAGAGAGTGGCACTTAGGTAATGGAGCCTCCATAGAATGGAGAATGAGAAAAT
ATAGCACACAAATAGATCCTGGCCTGGCAGACCAGCTAATTCATATGCATTATTTTGATTGTTTTGCAGA
CTCTGCCATAAGAAAAGCCATATTAGGACATATAGTTATCCCTAGGTGTGACTATCAAGCAGGACATAAT
AAGGTAGGATCTCTTCAATACTTGGCACTGACAGCATTGATAAAACCAAAAAAGAGAAAGCCACCTCTGC
CTAGTGTTAAGAAATTAGTAGAGGATAGATGGAACAACCCCCAGAAGACCAGGGGCCGCAGAGGGAACCA
TATAACGAGTGGACACTAG

VPR

ATGGAACAACCCCCAGAAGACCAGGGGCCGCAGAGGGAACCATATAACGAGTGGACACTAGAACTCTTAG
AGGAACTCAAGCAGGAAGCTGTCAGACACTTTCCTAGACCATGGCTCCATGCATTAGGACAACATATCTA
TGATACCTATGGGGATACTTGGACAGGAGTTGAAGCTATAATAAGAATACTTCAACAGTTACTGTTTACT
CATTTCAGAATTGGGTGCCAACATAGCAGAATAGGCATTCTGCGACAGAGAAGAGCAAGAAATGGAGCCA
GTAGACCCTAA

TAT

ATGGAGCCAGTAGACCCTAACCTAGAGCCCTGGAATCATCCAGGAAGTCAGCCCAAAACTCCTTGTAATA
AGTGTTATTGTAAGCGATGCTGCTATCATTGTCTAGTTTGCTTTCAGACAAAAGGCTTAGGCATTTCCCA
TGGCAGGAAGAAGCGGAGACAGCGACGAAGCGCTCCTCCAAGCAGTGAGAATCATCAAAATCCTTTATCA
AAGCAACCCTTATCCCAAGCCCGAGGGGACCAGACAGGCCCGGAGGAATCGAAGAAGAAGGTGGAGAGCA
AGACAGAAACAGATCAACGCGATTAG

REV

ATGGCAGGAAGAAGCGGAGACAGCGACGAAGCGCTCCTCCAAGCAGTGAGAATCATCAAAATCCTTTATC
AAAGCAACCCTTATCCCAAGCCCGAGGGGACCAGACAGGCCCGGAGGAATCGAAGAAGAAGGTGGAGAGC
AAGACAGAAACAGATCAACGCGATTAGTGAGCGGATTCTTAGCGCTTGTCTGGGACGACCTGCGGAGCCT
GTGCCTTTTCATCTACCACCGATTGAGAGACTTCATATTAATTGCAGCGAGAGCGGGGGAACTTCTGGGA
CGCAGCAGTCTCAAGGGACTACGGAGAGGATGGGAAGCCCTTAAGTATCTGGGAAGTCTTGTGCAGTATT
GGGGCCTGGAACTAAAAAGGAG

VPU

ATGTTTGATTTATATGCAAGAGTAGATTATAGAATAGGAGTAGGAGCATTGGCAATAGCACTAATCATAG
CAATAATAGTGTGGACCATAGTATATATAGAATATAGGAAATTAGTAAGACAAAGAAAAATAGACCAGTT
AATTAAAAGAATTAGGGAAAGAGCAGAAGACAGTGGCAATGAGAGTGATGGGGATACAGAGGAATTATCC
ACAATGGTGGATATGGAGCATGTTAGGCTTTTGGATGCTAATGATTTGTAA

Fig. 14B (cont.)

ENV

ATGAGAGTGATGGGGATACAGAGGAATTATCCACAATGGTGGATATGGAGCATGTTAGGCTTTTGGATGC
TAATGATTTGTAATGGGATGTGGGTCACAGTCTACTATGGGGTACCTGTGTGGAAAGAAGCAAAAACTAC
TCTATTTTGTGCATCAGATGCTAAAGCATATGAGAAAGAAGTGCATAATGTCTGGGCTACACATGCCTGT
GTACCCACAGACCCCAATCCACAAGAAATGGTTTTAAAAAATGTAACAGAAAATTTCAACATGTGGAAAA
ATGACATGGTGGATCAGATGCATGAAGATGTAATTAGTTTATGGGATCAAAGCCTCAAGCCATGTGTAAA
GTTGACCCCACTCTGTGTCACTCTAAACTGTACCAATGCTACTGCCAGCAATAGCAGTATAATAGAGGGA
ATGAAAAATTGCTCTTTCAATATAACCACAGAATTAAGAGATAAGAGAGAGAAAAAGAATGCACTTTTTT
ATAAACTTGATATAGTACAACTAGATGGCAACTCTAGTCAGTATAGATTAATAAATTGTAATACCTCAGT
CATAACACAAGCCTGTCCAAAGGTCTCTTTTGACCCAATTCCTATACATTATTGTGCTCCAGCTGGTTAT
GCGATTCTAAAGTGTAATAATAAGACATTCACTGGAACAGGACCGTGTAATAATGTCAGCACAGTACAAT
GTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAG
ATTGAGTGTACGAGACCCAATAATAAAACAAGAACAAGTATAAGAATAGGACCAGGACAAGCATTTTATG
CAACAGGACAAGTAATAGGAGACATAAGAGAAGCATATTGTAACATTAATGAAAGTAAATGGAATGAAAC
TTTACAAAGGGTAAGTAAAAAATTAAAAGAATACTTCCCTCATAAGAATATAACATTTCAACCATCCTCA
GGAGGGGACCTAGAAATTACAACACATAGCTTTAATTGTGGAGGAGAATTTTTCTATTGCAATACATCAA
GCCTGTTTAATAGGACATATATGGCTAATAGTACAGATATGGCTAATAGTACAGAAACTAACAGTACACG
AACCATCACAATCCACTGCAGAATAAAACAAATTATAAACATGTGGCAGGAGGTGGGACGAGCAATGTAT
GCCCCTCCCATTGCAGGAAACATAACATGTATATCAAATATCACAGGACTACTATTGACAAGGGATGGAG
GAAAAAACAATACGGAGACATTCAGACCTGGAGGAGGAAATATGAAGGACAATTGGAGAAGTGAATTATA
TAAATATAAAGTGGTAGAAGTTAAGCCATTAGGAGTAGCACCCACTAATGCAAGAAGGAGAGTGGTGGAG
AGAGAAAAAGAGCAGTGGGAATGGGAGCTGTGTTCCTTGGGTCTTGGGAGCGGCAGGAAGCACTATGG
GCGCAGCATCAATAACGCTGACGGTACAGGCCAGACAATTATTGTCTGGTATAGTGCAACAGCAAAGCAA
TTTGCTGAAGGCTATAGAGGCTCAACAGCATATGTTGAAACTCACGGTCTGGGGCATTAAACAGCTCCAG
GCAAGAGTCCTGGCCTTGGAAAGATACCTAAAGGATCAACAGCTCCTAGGGATGTGGGGCTGCTCTGGAA
AACTCATCTGCACCACTAATGTATATTGGAACTCTAGTTGGAGTAATAAAACTTATGGTGATATTTGGGA
TAACATGACCTGGATGCAGTGGGAGAGAGAAATTAGCAATTATACAGAAATAATATATGAATTGCTTGAA
GAATCACAAAACCAGCAGGAAAAGAATGAACAAGATTTACTAGCATTGGACAGATGGAACAGTCTGTGGA
ATTGGTTTAACATAACAAATTGGCTGTGGTATATAAAATATTCATAATGATAGTAGGAGGCTTGATAGG
TTTAAGAATAATTTTTGCTGTGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGAAGAAGAAGGTGGAGAGCAAG
ACAGAAACAGATCAACGCGATTAGTGAGCGGATTCTTAGCGCTTGTCTGGGACGACCTGCGGAGCCTGTG
CCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGG
GCCTGGAACTAAAAAGGAGTGCTATTAGTCTATTGGATACCCTAGCAATAGCAGTAGGTGAAGGAACAGA
TAGGATTCTAGAATTTGTATTAGGAATTTGTAGAGCTATCCGCAACATACCTACAAGAATAAGACAGGGC
TTTGAAACAGCTTTGCTATAA

Fig. 14B (cont.)

NEF

ATGGGGGGCAAGTGGTCAAAAAGCAGTATAGTTGGATGGCCTGATGTAAGAGAAAGAATAAGAAGAACTG
ATCCAGCAGCAGAGGGAGTAGGAGCAGCATCTCAAGACTTAGATAGACATGGGGCACTTACAATTAACAA
CACAGCCGCCAATAATGCTGATTGTGCCTGGCTGGAGGCACAAGAGGAGGAGGGAGAAGTAGGCTTTCCA
GTCAGACCTCAGGTACCTTTAAGACCAATGACTTATAAGGAAGCATTCGACCTCAGCTTCTTTTTAAAAG
AAAAGGGGGGACTGGAAGGGTTAGTTTACTCCAAGAAAAGACAAGAGATCCTTGATTTGTGGGTCTATAA
CACACAAGGCTTCTTCCCTGATTGGCAAAACTACACACCGGGACCAGGGGTCAGATATCCACTGACCTTT
GGATGGTGCTTCAAGCTAGTGCCAGTCGATCCAGAGGAAGTAGAAGAGGCCAATAAAGGAGAAAACAACT
GCTTACTACACCCTATGAGCCAGCATGGAATGGATGATGAGGACAGAGAAGTACTAAAGTGGAAGTTTGA
CAGTCAGCTAGCACGCAGACACATGGCCCGCGAGCTACATCCGGAGTGGTACAAAGACTGCTGA

| | Nucleotide position in the T/F sequence of Figure 14A |
|---|---|
| Gag | 792 -> 2276 |
| Pol | 2078 -> 5080 |
| Vif | 5025->5603 |
| Vpr | 5543->5833 |
| Tat1 | 5814->6028 |
| Rev1 | 5953->6028 |
| Vpu | 6053->6313 |
| Env | 6231 -> 8771 |
| Tat2 | 8334 -> 8424 |
| Rev2 | 8334 -> 8629 |
| Nef | 8773 -> 9396 |

Fig. 15 (CH505 gp160 nucleic acid sequences)

```
>w000.TF
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGTCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
```

Fig. 15 (cont.)
CTACAAGAATAAGACAGGGCTTTGAAACAGCTTTGCTATAA

>w004.03
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACGCATGGAATTAAGCCAGTGGTTTCAACTCAACTATTGTTAAATGGT
AGCCTAGCAGAAGGAGAGATAATAATTAGATCTGAAAATATAACAAACAA
TGTCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA

>w004.26
ATGAGAGTGATGGGGATACAGAGGAATTATCCACAATGGTGGATATGGAG
CATGTTAGGCTTTTGGATGCTAATGATTTGTAATGGGATGTGGGTCACAG

Fig. 15 (cont.)

TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGTCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATATACAGAAACTAACAGTACACGAACCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
TAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA

>w004.10
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA

Fig. 15 (cont.)
GTTGACCCCACTCTGTGTCACTCTAAACTGTACCAATGCTACTGCCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAAAAA
TGTCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
ATCCACTGCAGAATAAAACAAATTTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA >w014.3
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGACGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT

Fig. 15 (cont.)

```
CCTATACATTATTGTGCTCCAGCTGGTTATGTGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGTCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCAAA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAAGACAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAAAATTTGTATTAGGAATTTGTAGAGCTATCCGAAACATAC
CTACAAGAATAAGACAGGGCTTTGAAACAGCTTTGCTATAA

>w014.32
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGACGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTATTAAATGGT
AGCCTAGCAGAAGGAGAGATAATAATTAGATCTGAAAATATAACAAACAA
TGTCAAAACAATAATAGTACATCTCAATGAATCTGTAAAGATTGAGTGTA
```

Fig. 15 (cont.)

```
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCAAA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAAAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAAAATTTGTATTAGGAATTTGTAGAGCTATCCGCAACATAC
CTACAAGAATAAGACAGGGCTTTGAAACAGCTTTGCTATAA

>w014.2
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGTCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
```

Fig. 15 (cont.)

```
TTTCTATTGCAATACATCAAGCCTGTTTAATAGGACATATATGGCTAATA
GTACAGATATGGCTAATAGTACAGAAACTAACAGTACACGAACCATCACA
ATCCGCTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCCG
TGCTTTCGTTAGTAAATAGAGTTAGGCAGGATACTCACCTCTGTCGTTG
CAGACCCTTATCCCAAGCCCGAGGGGACCAGACAGGCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA

>w014.21
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGGCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAATCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
```

Fig. 15 (cont.)

```
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAAAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGACGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA

>w014.10
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAGATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTATCACTCTAAACTGTACCAATGCTACTGCCAGCA
ATAGCAGTATAATAGGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAGCCTGTCCAAATGCTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGGCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTACTA
GTACAGATATGGCTAATAGTACAGAAACTAACATACACGAATCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
```

Fig. 15 (cont.)

AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATCGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA

>w014.8
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACCCTATTTTGT
GCATCAGATGCTAAAGCATATGAGAAAGAAGTGCATAATGTCTGGGCTAC
ACATGCCTGTGTACCCACAGACCCCAATCCACAAGAAATGTTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGAGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGTCAAAACAATAATAGTACATCTCAATGAATCTGTAAAGATTGAGTGTA
CGAGACCCAATAATAAAACAAGAGCAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
ATCCGCTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA

Fig. 15 (cont.)
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGCCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA >w020.22
ATGAGAGTGATGGGGATACAGAGGAATTATCCACAATGGTGGATATGGAG
CATGTTAGGCTTTTGGATGCTAATGATATGTAATGGGATGTGGGTCACAG
TCTACTATGGGGTACCTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTACCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGTCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAGTGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGTTTTAATTGTGGAGGAGAATT
TTTCTATTGCAATACATCAAGCCTGTTTAATAGGACATATATGGCTAATA
GCACAGATATGGCTAATAGTACAGAAACTAACAGTACACGAACCATCACA
ATCCGCTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGCAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG

Fig. 15 (cont.)
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAGGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA >w020.7
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTAATGCCAGCA
ATAACAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGGCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAGTGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAATCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAATAAATATATGAGCTTCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCACATTAATTGCAGCGAGAGCGGGGGAACT
TCTGGGACGCAGCAGTCTCAAGGGACTACGGAGAGGATGGGAAGCCCTTA

Fig. 15 (cont.)
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA >w020.26
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATATCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGGCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGATATAAGAGAAGCATATTG
TAACATTAGTGAAAGTAAATGGAATGAAACTTTACAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAATCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA

Fig. 15 (cont.)
\>w020.4
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAACA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGGCAAAACAATAATAGTACATCTCAATGAATCTGTAAAGATTGAGTGTA
CGAGACCCAATAATAAAACAAGAACAAGTATAAGAATAGGACCAGGACGA
GCATTTTATGCAACAGGACTAATAGGAGACATAAGAGAAGCATATTG
TAACATTAGTGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
ATCCGCTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAAACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGCAGTGGGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGCACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAAGAATTTGTAGAGCTATCCGCAACATAC
CTACAAGAATAAGACAGGGCTTTGAAACAGCTTTGCTATAA \>w020.8
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTACATAATGTCTGGGCTAC

Fig. 15 (cont.)

```
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAACA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGCCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAAACATAAGAGAAGCATATTG
TAACATTAGTGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
CTCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA

>w020.14
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAACAGTATAATAGAGGGAATGAAAAATTGCTCTTTCAATATAACCACA
```

Fig. 15 (cont.)
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGCCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAAAAGCATATTG
TAACATTAGTGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
CTCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA >w020.15
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTACCAGCA
ATAGCAGTATAATAGAGGGAATGAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT Fig. 15 (cont.)
GTACACATGGAATTAAGCCAGTGGTTTCAACTCAACTATTGTTAAATGGT
AGCCTAGCAGAAGGAGAGATAATAATTAGATCTGAAAATATAACAAACAA
TGTCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAGTGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAATACACGAACCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAGCAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAAGACAGATCAAGGCCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA >w020.11
ATGAGAGTGATGGGGATACAAAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTACCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTTAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGTCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAAGAAACATAAGAGAAGCATATTG Fig. 15 (cont.)
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCAAA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTAGCCTTGGA
AAGATACCTAAAGGATCAACAGCTCCTAGGGATGTGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA >w020.23
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTACCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGCCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAAAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAATACACGAACCATCACA Fig. 15 (cont.)
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCGGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AATATCTGGGAAGTCTTGTGCAGTATTGGGGCCTGGAATTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA >w020.24
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTACCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGCCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
ATCCGCTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG

Fig. 15 (cont.)

CAAGAAGGAGAGTGGTGGAGAGAGAAAAAAGAGCAGTGGGAATGGGAGCT
GTGTTCCTTGGATTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGCCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA

>w020.9
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTGCCAGCAATA
GCAGTATAATAGAGGGAATGAAAAATTGCTCTTTCAATATAACCACAGAA
TTAAGAGATAAGAGAGAGAAAAAGAATGCACTTTTTTATAAACTTGATAT
AGTACAACTAGATGGCAACTCTAGTCAGTATAGATTAATAAATTGTAATA
CCTCAGTCATAACACAAGCCTGTCCAAAGGTCTCTTTTGACCCAATTCCT
ATACATTATTGTGCTCCAGCTGGTTATGCGATTCTAAAGTGTAATAATAA
GACATTCACTGGAACAGGACCGTGTAATAATGTCAGCACAGTACAATGTA
CACATGGAATTAAGCCAGTGGTTTCAACTCAACTATTGTTAAATGGTAGC
CTAGCAGAAGGAGAGATAATAATTAGATCTGAAAATATAACAAACAATGC
CAAAACAATAATAGTACATCTCAATGAATCTGTAAAGATTGAGTGTACGA
GACCCAATAATAAAACAAGAACAAGTATAAGAATAGGACCAGGACAAGCA
TTTTATGCAACAGGACAAGTAATAGGAGACATAAGAAAGCATATTGTAA
CATTAATGAAAGTAAATGGAATGAAACTTTACAAAGGGTAAGTAAAAAAT
TAAAAGAATACTTCCCTCATAAGAATATAACATTTCAACCATCCTCAGGA
GGGGACCTAGAAATTACAACACATAGCTTTAATTGTGGAGGAGAATTTTT
CTATTGCAATACATCAAGCCTGTTTAATAGGACATATATGGCCTAATAGTA
CAGATATGGCTAATAGTACAGAAACTAACAATACACGAACCATCACAATC
CACTGCAGAATAAAACAAATTATAAACATGTGGCAGGAGGTGGGACGAGC
AATGTATGCCCCTCCCATTGCAGGAAACATAACATGTATATCAAATATCA
CAGGACTACTATTGACAAGGGATGGAGGAAAAACAATACGGAGACATTC
AGACCTGGAGGAGGAAATATGAAGGACAATTGGAGAAGTGAATTATATAA
ATATAAAGTGGTAGAAGTTAAGCCATTAGGAGTAGCACCCACTAATGCAA
GAAGGAGAGTGGTGGAAAGAGAAAAAGAGCAGTGGGAATGGGAGCTGTG
TTCCTTGGGTTCTTGGGAGCGGCAGGAAGCACTATGGGCGCAGCATCAAT
AACGCTGACGGTACAGGCCAGACAATTATTGTCTGGTATAGTGCAACAGC
AAAGCAATTTGCTGAAGGCTATAGAGGCTCAACAGCATATGTTGAAACTC
ACGGTCTGGGGCATTAAACAGCTCCAGGCAAGAGTCCTGGCCTTGGAAAG

Fig. 15 (cont.)
ATACCTAAAGGATCAACAGCTCCTAGGGATGTGGGGCTGCTCTGGAAAAC
TCATCTGCACCACTAATGTATATTGGAACTCTAGTTGGAGTAATAAAACT
TATGGTGATATTTGGGATAACATGACCTGGATGCAGTGGGAGAGAGAAAT
TAGCAATTATACAGAAATAATATATGAATTGCTTGAAGAATCACAAAACC
AGCAGGAAAAGAATGAACAAGATTTACTAGCATTGGACAGATGGAACAGT
CTGTGGAATTGGTTTAACATAACAAATTGGCTGTGGTATATAAAAATATT
CATAATGATAGTAGGAGGCTTGATAGGTTTAAGAATAATTTTTGCTGTGC
TTTCTTTAGTAAATAGAGTTAGGCAGGGATACTCACCTCTGTCGTTGCAG
ACCCTTATCCCAAGCCCGAGGGGACCAGACAGGCCCGGAGGAATCGAAGA
AGAAGGTGGAGAGCAAGACAGAAACAGATCAACGCGATTAGTGAGCGGAT
TCTTAGCGCTTGCCTGGGACGACCTGCGGAGCCTGTGCCTTTTCATCTAC
CACCGATTGAGAGACTTCATATTAATTGCAGCGAGAGCGGGGGAACTTCT
GGGACGCAGCAGTCTCAAGGGACTACGGAGGGATGGGAAGCCCTTAAGT
ATCTGGGAAGTCTTGTGCAGTATTGGGGCCTGGAACTAAAAAGGAGTGCT
ATTAGTCTATTGGATACCCTAGCAATAGCAGTAGGTGAAGGAACAGATAG
GATTCTAGAATTTGTATTAGGAATTTGTAGAGCTATCCGCAACATACCTA
CAAGAATAAGACAGGGCTTTGAAACAGCTTTGCTATAA >w020.19
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATGCTACTGCCAGCAATAGCAGTATAATAGAGGGAATGAAAAATTGCTCT
TTCAATATAACCACAGAATTAAGAGATAAGAGAGAGAAAAAGAATGCACT
TTTTTATAAACTTGATATAGTACAACTAGATGGACCTCTAGTCAGTATA
GATTAATAAATTGTAATACCTCAGTCATAACACAAGCCTGTCCAAAGGTC
TCTTTTGACCCAATTCCTATACATTATTGTGCTCCAGCTGGTTATGCGAT
TCTAAAGTGTAATAATAAGACATTCACTGGAACAGGACCGTGTAATAATG
TCAGCACAGTACAATGTACACATGGAATTAAGCCAGTGGTTTCTACTCAA
CTATTGTTAAATGGTAGCCTAGCAGAAGGAGAGATAATAATTAGATCTGA
AAATATAACAAACAATGTCAAAACAATAATAGTACATCTCAATGAATCTG
TAAAGATTGAGTGTACGAGACCCAATAATAAAACAAGAAAAGTATAAGA
ATAGGACCAGGACAAGCATTTTATGCAACAGGACAAGTAATAGGAGACAT
AAGAGAAGCATATTGTAACATTAGTGAAAGTAAATGGAATGAAACTTTAC
AAAGGGTAAGTAAAAAATTAAAAGAATACTTCCCTCATAAGAATATAACA
TTTCAACCATCCTCAGGAGGGGACCTAGAAATTACAACACATAGCTTTAA
TTGTGGAGGAGAATTTTTCTATTGCAATACATCAAGCCTGTTTAATAGGA
CATATATGGCTAATAGTACAGATATGGCTAATAGTACAGAAACTAACAGT
ACACGAACCATCACAATCCGCTGCAGAATAAAACAAATTATAAACATGTG
GCAGGAGGTGGGACGAGCAATGTATGCCCCTCCCATTGCAGGAAACATAA
CATGTATATCAAATATCACAGGACTACTATTGACAAGGGATGGAGGAAAA
AACAATACGGAGACATTCAGACCTGGAGGAGGAAATATGAAGGACAATTG
GAGAAGTGAATTATATAAATATAAAGTTAAGCCATTAGGAG
TAGCACCCACTAATGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA
CAGCATATGTTGAAACTCACGGTCTGGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGTTGGAGTAATAAAACTTATGGTGATATTTGGGATAACATGACCTGGAT
GCAGTGGGAGAGAGAAATTAGCAATTATACAGAAATAATATATGAATTGC
TTGAAGAATCACAAAACCAGCAGGAAAAGAATGAACAAGATTTACTAGCA

Fig. 15 (cont.)

```
TTGGACAGATGGAACAGTCTGTGGAATTGGTTTAACATAACAAATTGGCT
GTGGTATATAAAAATATTCATAATGATAGTAGGAGGCTTGATAGGTTTAA
GAATAATTTTTGCTGTGCTTTCTTTAGTAAATAGAGTTAGGCAGGGATAC
TCACCTCTGTCGTTACAGACCCTTATCCCAAGCCCGAGGGGACCAGACAG
GCCCGGAGGAATCGAAGAAGAAGGTGGAGAGCAAGACAGAAACAGATCAA
CGCGATTAGTGAGCGGATTCTTAGCGCTTGTCTGGGACGACCTGCGGAGC
CTGTGCCTTTTCATCTACCACCGATTGAGAGACTTCATATTAATTGCAGC
GAGAGCGGGGGAACTTCTGGGACGCAGCAGTCTCAAGGGACTACGGAGAG
GATGGGAAGCCCTTAAGTATCTGGGAAGTCTTGTGCAGTATTGGGGCCTG
GAACTAAAAAGGAGTGCTATTAGTCTATTGGATACCCTAGCAATAGCAGT
AGGTGAAGGAACAGATAGGATTCTAGAATTTGTATTAGGAATTTGTAGAG
CTATCCGCAACATACCTACAAGAATAAGACAGGGCTTTGAAACAGCTTTG
CTATAA

>w020.13
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATGCTACTGCCAGCAATAGCAGTATAATAGAGGGAATGAAAAATTGCTCT
TTCAATATAACCACAGAATTAAGAGATAAGAGAGAGAAAAAGAATGCACT
TTTTTATAAACTTGATATAGTACAACTAGATGGCAACTCTAGTCAGTATA
GATTAATAAATTGTAATACCTCAGTCATAACACAAGCCTGTCCAAAGGTC
TCTTTTGACCCAATTCCTATACATTATTGTGCTCCAGCTGGTTATGCGAT
TCTAAAGTGTAATAATAAGACATTCACTGGAACAGGACCGTGTAATAATG
TCAGCACAGTACAATGTACACATGGAATTAAGCCAGTGGTTTCTACTCAA
CTATTGTTAAATGGTAGCCTAGCAGAAGGAGAGATAATAATTAGATCTGA
AAATATAACAAACAATGTCAAAACAATAATAGTACATCTCAATGAATCTG
TAAAGATTGAGTGTACGAGACCCAATAATAAAACAAGAAAAAGTATAAGA
ATAGGACCAGGACAAGCATTTTATGCAACAGGACAAGTAATAGGAGACAT
AAGAGAAGCATATTGTAACATTAATGAAAGTAAATGGAATGAAACTTTAC
AAAGGGTAAGTAAAAAATTAAAAGAATATTTCCCTCATAAGAATATAACA
TTTCAACCATCCTCAGGAGGGGACCTAGAAATTACAACACATAGCTTTAA
TTGTGGAGGAGAATTTTTCTATTGCAATACATCAAGCCTGTTTAATAGGA
CATATATGGCTAATAGTACAGATATGGCTAATAGTACAGAAACTAACAGT
ACACGAACCATCACAATCCGCTGCAGAATAAAACAAATTATAAACATGTG
GCAGGAGGTGGGACGAGCAATGTATGCCCCTCCCATTGCAGGAAACATAA
CATGTATATCAAATATCACAGGACTACTATTGACAAGGGATGGAGGAAAA
AACAATACGGAGACATTCAGACCTGGAGGAGGAAATATGAAGGACAATTG
GAGAAGTGAATTATATAAATATAAAGTGGTAGAAGTTAAGCCATTAGGAG
TAGCACCCACTAATGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA
CAGCATATGTTGAAACTCACGGTCTGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGTTGGAGTAATAAAACTTATGGTGATATTTGGGATAACATGACCTGGAT
GCAGTGGGAGAGAGAAATTAGCAATTATACAGAAATAATATATGAATTGC
TTGAAGAATCACAAAACCAGCAGGAAAAGAATGAACAAGATTTACTAGCA
TTGGACAGATGGAACAGTCTGTGGAATTGGTTTAACATAACAAATTGGCT
GTGGTATATAAAAATATTCATAATGATAGTAGGAGGCTTGATAGGTTTAA
GAATAATTTTTGCTGTGCTTTCTTTAGTAAATAGAGTTAGGCAGGGATAC
TCACCTCTGTCGTTACAGACCCTTATCCCAAGCCCGAGGGGACCAGACAG
```

Fig. 15 (cont.)
GCCCGGAGGAATCGAAGAAGAAGGTGGAGAGCAAGACAGAAACAGATCAA
CGCGATTAGTGAGCGGATTCTTAGCGCTTGTCTGGGACGACCTGCGGAGC
CTGTGCCTTTTCATCTACCACCGATTGAGAGACTTCATATTAATTGCAGC
GAGAGCGGGGGAACTTCTGGGACGCAGCAGTCTCAAGGGACTACGGAGAG
GATGGGAAGCCCTTAAGTATCTGGGAAGTCTTGTGCAGTATTGGGGCCTG
GAACTAAAAAGGAGTGCTATTAGTCTATTGGATACCCTAGCAATAGCAGT
AGGTGAAGGAACAGATAGGATTCTAGAATTTGTATTAGGAATTTGTAGAG
CTATCCGCAACATACCTACAAGAATAAGACAGGGCTTTGAAACAGCTTTG
CTATAA >w020.3
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATACCAATGCTACTGCCAGCAATAGCAGTACAATAGAGGGAATGAAAAAT
TGCTCTTTCAATATAACCACAGAATTAAGAGATAAGAGAGAGAAAAAGAA
TGCACTTTTTTATAAACTTGATATAGTACAACTAGATGGCAACTCTAGTC
AGTATAGATTAATAAATTGTAATACCTCAGTCATAACACAAGCCTGTCCA
AAGGTCTCTTTTGACCCAATTCCTATACATTATTGTGCTCCAGCTGGTTA
TGCGATTCTAAAGTGTAATAATAAGACATTCACTGGAACAGGACCGTGTA
ATAATGTCAGCACAGTACAATGTACACATGGAATTAAGCCAGTGGTTTCA
ACTCAACTATTGTTAAATGGTAGCCTAGCAGAAGGAGAGATAATAATTAG
ATCTGAAAATATAACAAACAATGCCAAAACAATAATAGTACATCTCAATG
AATCTGTAAAGATTGAGTGTACGAGACCCAATAATAAAACAAGAACAAGT
ATAAGAATAGGACCAGGACAAGCATTTTATGCAACAGGACAAGTAATAGG
AAACATAAGAGAAGCATATTGTAACATTAGTGAAAGTAAATGGAATGAAA
CTTTACAAAGGGTAAGTAAAAAATTAAAAGAATACTTCCCTCATAAGAAT
ATAACATTTCAACCATCCTCAGGAGGGGACCTAGAAATTACAACACATAG
CTTTAATTGTGGAGGAGAATTTTTCTATTGCAATACATCAAGCCTGTTTA
ATAGGACATATATGGCTAATAGTACAGATATGGCTAATAGTACAGAAACT
AACAGTACACGAATCATCACAATCCACTGCAGAATAAAACAAATTATAAA
CATGTGGCAGGAGGTGGGACGAGCAATGTATGCCCCTCCCATTGCAGGAA
ACATAACATGTATATCAAATATCACAGGACTACTATTGACAAGGGATGGA
GGAAAAAACAATACGAAGACATTCAGACCTGGAGGAGGAAATATGAAGGA
CAATTGGAGAAGTGAATTATATAAATATAAAGTGGTAGAAGTTAAGCCAT
TAGGAGTAGCACCCACTAATGCAAGAAGGAGAGTGGTGGAGAGAGAAAAA
AGAGCAGTGGGAATGGGAGCTGTGTTCCTTGGGTTCTTGGGAGCGGCAGG
AAGCACTATGGGCGCAGCATCAATAACGCTGACGGTACAGGCCAGACAAT
TATTGTCTGGTATAGTGCAACAGCAAAGCAATTTGCTGAAGGCTATAGAG
GCTCAACAGCATATGTTGAAACTCACGGTCTGGGGCATTAAACAGCTCCA
GGCAAGAGTCCTGGCCTTGGAAAGATACCTAAAGGATCAACAGCTCCTAG
GGATGTGGGGCTGCTCTGGAAAACTCATCTGCACCACTAATGTATATTGG
AACTCTAGTTGGAGTAATAAAACTTATGGTGATATTTGGGATAACATGAC
CTGGATACAGTGGGAGAGAGAAATTAGCAATTATACAGAAATAATATATG
AATTGCTTGAAGAATCACAAAACCAGCAGGAAAAGAATGAACAAGATTTA
CTAGCATTGGACAGATGGAACAGTCTGTGGAATTGGTTTAACATAACAAA
TTGGCTGTGGTATATAAAATATTCATAATGATAGTAGGAGGCTTGATAG
GTTTAAGAATAATTTTTGCTGTGCTTTCTTTAGCAAATAGAGTTAGGCAG
GGATACTCACCTCTGTCGTTGCAGACCCTTATCCCAAGCCCGAGGGGACC
AGACAGGCCCGGAGGAATCGAAGAAGAAGGTGGAGAGCAAGACAGAAACA
GATCAACGCGATTAGTGAGCGGATTCTTAGCGCTTGTCTGGGACGACCTG
CGGAGCCTGTGCCTTTTCATCTACCACCGATTGAGAGACTTCATATTAAT
TGCAGCGAGAGCGGGGGAACTTCTGGGACGCAGCAGTCTCAAGGGACTAC

Fig. 15 (cont.)
GGAGAGGATGGGAAGCCCTTAAGTATCTGGGAAGTCTTGTGCAGTATTGG
GGCCTGGAACTAAAAAGGAGTGCTATTAGTCTATTGGATACCCTAGCAAT
AGCAGTAGGTGAAGGAACAGATAGGATTCTAGAATTTGTATTAGGAATTT
GTAGAGCTATCCGCAACATACCTACAAGAATAAGACAGGGCTTTGAAACA
GCTTTGCTATAA >w030.11
ATGAGAGTGATGGGGATACAGAGGAATTATCCACAATGGTGGATATGGAG
CATGTTAGGCTTTTGGATGCTAATGATTTGTAAAGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTTTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGATCAAAGCCTCAAGCCATGTGTAAA
GTTGACCCCACTCTGTGTCACTCTAAACTGTACCAATGCTACTGCCAGCA
ATATCAGTAATAGAGGAAATGAAAAATTGCTCTTTCAATATAACCACAGA
ATTAAGAGATAAGAGAGAGAAAAAGAATGCACTTTTTTATAAACTTGATA
TAGTACAACTAGATGGCAACTCTAGTCAGTATAGATTAATAAATTGTAAT
ACCTCAGTCATAACACAAGCCTGTCCAAAGGTCTCTTTTGACCCAATTCC
TATACATTATTGTGCTCCAGCTGGTTATGCGATTCTAAAGTGTAATAATA
AGACATTCACTGGAACAGGACCGTGTAATAATGTCAGCACAGTACAATGT
ACACATGGAATTAAGCCAGTGGTTTCAACTCAACTATTGTTAAATGGTAG
CCTAGCAGAAGGAGAGATAATAATTAGATCTGAAAATATAACAGACAATG
TCAAAACAATAATAGTACATCTCAATGAATCTGTAAAGATTGAGTGTACG
AGACCCAATAATAAAACAAGAACAAGTATAAGAATAGGACCAGGACAAGC
ATTTTATGCAACAGGACAAGTAATAGGAGACATAAGAGAAGCATATTGTA
ACATTAGTGAAAGTAAATGGAATGAAACTTTACAAAGGGTAAGTAAAAAA
TTAAAAGAATACTTCCCTCATAAGAATATAACATTTCAACCATCCTCAGG
AGGGGACCTAGAAATTACAACACATAGCTTTAATTGTGGAGGAGAATTTT
TCTATTGCAATACATCAAGCCTGTTTAATAGGACATATATGGCTAATAGT
ACAGAAACTAACAGTACACGAACCATCACAATCCGCTGCAGAATAAAACA
AATTATAAACATGTGGCAGGAGGTGGGACGAGCAATGTATGCCCCTCCCA
TTGCAGGAAACATAACATGTATATCAAATATCACAGGACTACTATTGACA
AGGGATGGAGGAAAAAACAATACGGATACGGAGACATTCAGACCTGGAGG
AGGAAATATGAAGGACAATTGGAGAAGTGAATTATATAAATATAAAGTGG
TAGAAGTTAAGCCATTAGGAGTAGCACCCACTAATGCAAGAAGGAGAGTG
GTGGAGAGAGAAAAAAGAGCAGTGGGAATGGGAGCTGTGTTCCTTGGGTT
CTTGGGAGCGGCAGGAAGCACTATGGGCGCAGTCAATAACGCTGACGG
TACAGGCCAGACAATTATTGTCTGGTATAGTGCAACAGCAAAGCAATTTG
CTGAAGGCTATAGAGGCTCAACAGCATATGTTGAAACTCACGGTCTGGGG
CATTAAACAGCTCCAGGCAAGAGTCCTGGCCTTGGAAAGATACCTAAAGG
ATCAACAGCTCCTAGGGATGTGGGGCTGCTCTGGAAAACTCATCTGCACC
ACTAATGTATATTGGAACTCTAGTTGGAGTAATAAAACTTATGGTGATAT
TTGGGATAACATGACCTGGATGCAGTGGGAGAGAGAAATTAGCAATTATA
CAGAAATAATATATGAATTGCTTGAAGAATCACAAAACCAGCAGGAAAAG
AATGAACAAGATTTACTAGCATTGGACAGATGGAACAGTCTGTGGAATTG
GTTTAACATAACAAATTGGCTGTGGTATATAAAAATATTCATAATGATAG
TAGGAGGCTTGATAGGTTTAAGAATAATTTTTGCTGTGCTTTCTTTAGTA
AATAGAGTTAGGCAGGGATACTCACCTCTGTCGTTACAGACCCTTATCCC
AAGCCCGAGGGACCAGACAGGCCCGGAGGAATCGAAGAAGAAGGTGGAG
AGCAAGACAGAAACAGATCAACGCGATTAGTGAGCGGATTCTTAGCGCTT
GTCTGGGACGACCTGCGGAGCCTGTGCCTTTTCATCTACCACCGATTGAG
AGACTTCATATTAATTGCAGCGAGAGCGGGGGAACTTCTGGGACGCAGCA
GTCTCAAGGGACTACGGAGAGGATGGGAAGCCCTTAAGTATCTGGGAAGT
CTTGTGCAGTATTGGGGCCTGGAACTAAAAAGGAGTGCTATTAGTCTATT
GGATACCCTAGCAATAGCAGTAGGTGAAGGAACAGATAGGATTCTAGAAT
TTGTATTAGGAATTTGTAGAGCTATCCGCAACATACCTACAAGAATAAGA
CAGGGCTTTGAAACAGCTTTGCTATAA

Fig. 15 (cont.)

>w030.20
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTACCAATG
CTACTGCCAGCAATAGCAGTATAATAGAGGGAATGAAAAATTGCTCTTTC
AATATAACCACAGAATTAAGAGATAAGAGAGAGAAAAAGAATGCACTTTT
TTATAAACTTGATATAGTACAACTAGATGGCAACTCTAGTCAGTATAGAT
TAATAAATTGTAATACCTCAGTCATAACACAAGCCTGTCCAAAGGTCTCT
TTTGACCCAATTCCTATACATTATTGTGCTCCAGCTGGTTATGCGATTCT
AAAGTGTAATAATAAGACATTCACTGGAACAGGACCGTGTAATAATGTCA
GCACAGTACAATGTACACATGGAATTAAGCCAGTGGTTTCAACTCAACTA
TTGTTAAATGGTAGCCTAGCAGAAGGAGAGATAATAATTAGATCTGAAAA
TATAACAAACAATGCCAAAACAATAGTACATCTCAATGAATCTGTAA
AGATTGAGTGTACGAGACCCAATAATAAAACAAGAACAAGTATAAGAATA
GGACCAGGACAAGCATTTTATGCAACAGGACAAGTAATAGGAGACATAAG
AGAAGCATATTGTAACATTAGTGAAAGTAAATGGAATGAAACTTTACAAA
GGGTAAGTAAAAAATTAAAAGAATACTTCCCTCATAAGAATATAACATTT
CAACCATCCTCAGGAGGGGACCTAGAAATTACAACACATAGCTTTAATTG
TGGAGGAGAATTTTTCTATTGCAATACATCAAGCCTGTTTAATAGGACAT
ATATGGCTAATAGTACAGATATGGCTAATAGTACAGAAACTAACAGTACA
CGAATCATCACAATCCACTGCAGAATAAAACAAATTATAAACATGTGGCA
GGAGGTGGGACGAGCAATGTATGCCCCTCCCATTGCAGGAAACATAACAT
GTATATCAAATATCACAGGACTACTATTGACAAGGGATGGAGGAAAAAAC
ACAAGGGATGGAGGAAAAAACAATACGGAGACATTCAGACCTGGAGGAGG
AAATATGAAGGACAATTGGAGAAGTGAATTATATAAATATAAAGTGGTAG
AAGTTAAGCCATTAGGAGTAGCACCCACTAATGCAAGAAGGAGAGTGGTG
GAGAGAGAAAAAGAGCAGTGGGAATGGGAGCTGTGTTCCTTGGGTTCTT
GGGAGCGGCAGGAAGCACTATGGGCGCAGCATCAATAACGCTGACGGTAC
AGGCCAGACAATTATTGTCTGGTATAGTGCAACAGCAAAGCAATTTGCTG
AAGGCTATAGAGGCTCAACAGCATATGTTGAAACTCACGGTCTGGGGCAT
TAAACAGCTCCAGGCAAGAGTCCTGGCCTTGGAAAGATACCTAAAGGATC
AACAGCTCCTAGGGATGTGGGGCTGCTCTGGAAAACTCATCTGCACCACT
AATGTATATTGGAACTCTAGTTGGAGTAATAAAACTTATGGTGATATTTG
GGATAACATGACCTGGATGCAGTGGGAGAGAGAAATTAGCAATTATACAG
AAATAATATATGAATTGCTTGAAGAATCACAAAACCAGCAGGAAAAGAAT
GAACAAGATTTACTAGCATTGGACAGATGGAACAGTCTGTGGAATTGGTT
TAACATAACAAATTGGCTGTGGTATATAAAAATATTCATAATGATAGTAG
GAGGCTTGATAGGTTTAAGAATAATTTTTGCTGTGCTTTCTTTAGTAAAT
AGAGTTAGGCAGGGATACTCACCTCTGTCGTTGCAGACCCTTATCCCAAG
CCCGAGGGGACCAGACAGGCCCGGAGGAATCGAAGAAGAAGGTGGAGAGC
AAGACAGAAACAGATCAACGCGATTAGTGAGCGGATTCTTAGCGCTTGCC
TGGGACGACCTGCGGAGCCTGTGCCTTTTCATCTACCACCGATTGAGAGA
CTTCATATTAATTGCAGCGAGAGCGGGGGAACTTCTGGGACGCAGCAGTC
TCAAGGGACTACGGAGAGGATGGGAAGCCCTTAAGTATCTGGGAAGTCTT
GTGCAGTATTGGGGCCTGGAACTAAAAAGGAGTGCTATTAGTCTATTGGA
TACCCTAGCAATAGCAGTAGGTGAAGGAACAGATAGGATTCTAGAATTTG
TATTAGGAATTTGTAGAGCTATCCGCAACATACCTACAAGAATAAGACAG
GGCTTTGAAACAGCTTTGCTATAA

>w030.17
ATGAGAGTGATGGGGATACAGAGGAATTATCCACAATGGTGGATATGGAG
CATGTTAGGCTTTTGGATGCTAATGATTTGTAATGGGATGTGGGTCACAG

Fig. 15 (cont.)

TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGACGTAATTAGTTTATGGGATCAAAGCCTCAAGCCATGTGTAAA
GTTGACCCCACTCTGTGTTACTCTAAACTGTACCAATGCTACTAATGCTA
CTGCCAGCAATAGCAGTATAATAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGATGGCAACTCCAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCACTGGAACAGGATCGTGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTGAAAATAT
AACAGACAATGGCAAAACAATAATAGTACATCTCAATGAATCTGTAAAGA
TTGAGTGTACGAGACCCAATAATAAAACAAGAACAAGTATAAGAATAGGA
CCAGGACAAGCATTTTATGCAACAGGACAAGTAATAGGAGACATAAAAGA
AGCATATTGTAACATTAGTGAAAGTAAATGGAATGAAACTTTACAAAGGG
TAAGTAAAAAATTAAAAGAATACTTCCCTCATAAGAATATAACATTTCAA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTAATAGTACAGATATGGCTAATAGTACAGAAACTAACAGTACACGA
AACATCACAATCCACTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAAAACAAT
ACGGATACGGAGACATTCAGACCTGGAGGAGGAAATATGAAGGACAATTG
GAGAAGTGAATTATATAAATATAAAGTGGTAGAAGTTAAGCCATTAGGAG
TAGCACCCACTAATGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGCAATTATTGT
CTGGTATAGTGCAACAGCAAAGCAATTTGCTGAAGGCTATAGAGGCTCAA
CAGCATATGTTGAAACTCACGGTCTGGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGTTGGAGTAATAAAACTTATGGTGATATTTGGGATAACATGACCTGGAT
GCAGTGGGAGAGAGAAATTAGCAATTATACAGAAATAATATATGAATTGC
TTGAAGAATCACAAAACCAGCAGGAAAAGAATGAACAAGATTTACTAGCA
TTGGACAGATGGAACAGTCTGTGGAATTGGTTTAACATAACAAATTGGCT
GTGGTATATAAAAATATTCATAATGATAGTAGGAGGCTTGATAGGTTTAA
GAATAATTTTTGCTGTGCTTTCTTTAGTAAATAGAGTTAGGCAGGGATAC
TCACCTCTGTCGTTACAGACCCTTATCCCAAGCCCGAGGGGACCAGACAG
GCCCGGAGGAATCGAAGAAGAAGGTGGAGAGCAAGACAGAAACAGATCAA
CGCGATTAGTGAGCGGATTCTTAGCGCTTGTCTGGGACGACCTGCGGAGC
CTGTGCCTTTTCATCTACCACCGATTGAGAGACTTCATATTAATTGCAGC
GAGAGCGGGGAACTTCTGGGACGCAGCAGTCTCAAGGGACTACGGAGAG
GATGGGAAGCCCTTAAGTATCTGGGAAGTCTTGTGCAGTATTGGGGCCTG
GAACTAAAAAGGAGTGCTATTAGTCTATTGGATACCCTAGCAATAGCAAT
AGGTGAAGGAACAGATAGGATTCTAGAATTTGTATTAGGAATTTGTAGAG
CTATCCGCAACATACCTACAAGAATAAGACAGGGCTTTGAAACAGCTTTG
CTATAA

>w030.6
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG

Fig. 15 (cont.)
CATGAAGACGTAATTAGTTTATGGGATCAAAGCCTCAAGCCATGTGTAAA
GTTGACCCCACTCTGTGTCACTCTAAACTGTACCAATGCTACTACCAATG
CTACTGCCAGCAATAGCAGTATAATAGAGGGAATGAAAAATTGCTCTTTC
AATATAACCACAGAATTAAGAGATAAGAGAGAGAAAAAGAATGCACTTTT
TTATAAACTTGATATAGTACAACTAGATGGCAACTCTAGTCAGTATAGAT
TAATAAATTGTAATACCTCAGTCATAACACAAGCCTGTCCAAAGGTCTCT
TTTGACCCAATTCCTATACATTATTGTGCTCCAGCTGGTTATGCGATTCT
AAAGTGTAATAATAAGACATTCACTGGAACAGGACCGTGTAATAATGTCA
GCACAGTACAATGTACACATGGAATTAAGCCAGTGGTTTCAACTCAACTA
TTGTTAAATGGTAGCCTAGCAGAAGGAGAGATAATAATTAGATCTGAAAA
TATAACAAACAATGCCAAAACAATAATAGTACATCTCAATGAATCTGTAA
AGATTGAGTGTACGAGACCCAGTAATAAAACAAGAACAAGTATAAGAATA
GGACCAGGACAAGCATTTTATGCAACAGGACAAGTAATAGGAGACATAAG
AGAAGCATATTGTAACATTAGTGAAAGTAAATGGAATGAAACTTTACAAA
GGGTAAGTAAAAAATTAAAAGAATACTTCCCTCATAAGAATATAACATTT
CAACCATCCTCAGGAGGGGACCTAGAAATTACAACACATAGCTTTAATTG
TGGAGGAGAATTTTTCTATTGCAATACATCAAGCCTGTTTAATAGGACAT
ATATGGCTAATAGTACAGATATGGCTAATAGTACAGAAACTAACAGTACA
CGAACCATCACAATCCGCTGCAGAATAAAACAAATTATAAACATGTGGCA
GGAGGTGGGACGAGCAATGTATGCCCCTCCCATTGCAGGAAACATAACAT
GTATATCAAATATCACAGGACTACTATTGACAAGGGATGGAGGAAAAAAC
AATACGGATACGGAGACATTCAGACCTGGAGGAGGAAATATGAAGGACAA
TTGGAGAAGTGAATTATATAAATATAAAGTGGTAGAAGTTAAGCCATTAG
GAGTAGCACCCACTAATGCAAGAAGGAGAGTGGTGGAGAGAGAAAAAAGA
GCAGTGGGAATGGGAGCTGTGTTCCTTGGGTTCTTGGGAGCGGCAGGAAG
CACTATGGGCGCAGCATCAATAACGCTGACGGTACAGGCCAGACAATTAT
TGTCTGGTATAGTGCAACAGCAAAGCAATTTGCTGAAGGCTATAGAGGCT
CAACAGCATATGTTGAAACTCACGGTCTGGGGCATTAAACAGCTCCAGGC
AAGAGTCCTGGCCTTGGAAAGATACCTAAAGGATCAACAGCTCCTAGGGA
TGTGGGGCTGCTCTGGAAAACTCATCTGCACCACTAATGTATATTGGAAC
TCTAGTTGGAGTAATAAAACTTATGGTGATATTTGGGATAACATGACCTG
GATGCAGTGGGAGAGAGAAATTAGCAATTATACAGAAATAATATATGAAT
TGCTTGAAGAATCACAAAACCAGCAGGAAAAGAATGAACAAGATTTACTA
GCATTGGACAGATGGAACAGTCTGTGGAATTGGTTTAACATAACAAATTG
GCTGTGGTATATAAAAGTATTCATAATGATAGTAGGAGGCTTGATAGGTT
TAAGAATAATTTTTGCTGTGCTTTCTTTAGTAAATAGAGTTAGGCAGGGA
TACTCACCTCTGTCGTTACAGACCCTTATCCCAAGCCCGAGGGGACCAGA
CAGGCCCGGAGGAATCGAAGAAGAAGGTGGAGACCAAGACAGAAACAGAT
CAACGCGATTAGTGAGCGGATTCTTAGCGCTTGTCTGGGACGACCTGCGG
AGCCTGTGCCTTTTCATCTACCACCGATTGAGAGACTTCATATTAATTGC
AGCGAGAGCGGGGGAACTTCTGGGACGCAGCAGTCTCAAGGGACTACGGA
GAGGATGGGAAGCCCTTAAGTATCTGGGAAGTCTTGTGCAGTATTGGGGC
CTGGAACTAAAAAGGAGTGCTATTAGTCTATTGGATACCCTAGCAATAAC
AGTAGGTGAAGGAACAGATAGGATTCTAGAATTTGTATTAGGAATTTGTA
GAGCTATCCGCAACATACCTACAAGAATAAGACAGGGCTTTGAAACAGCT
TTGCTATAA >w030.25
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTACCAATG
CTACTGCCAGCAATAGCAGTATAATAGAGGGAATGAAAAATTGCTCTTTC
AATATAACCACAGAATTAAGAGATAAGAGAGAGAAAAAGAATGCACTTTT

Fig. 15 (cont.)

```
TTATAAACTTGATATAGTACAACTAGATGGCAACTCTAGTCAGTATAGAT
TAATAAATTGTAATACCTCAGTCATAACACAAGCCTGTCCAAAGGTCTCT
TTTGACCCAATTCCTATACATTATTGTGCTCCAGCTGGTTATGCGATTCT
AAAGTGTAATAATAAGACATTCACTGGAACAGGACCGTGTAATAATGTCA
GCACAGTACAATGTACACATGGAATTAAGCCAGTGGTTTCAACTCAACTA
TTGTTAAATGGTAGCCTAGCAGAAGGAGAGATAATAATTAGATCTGAAAA
TATAACAAACAATGCCAAAACAATAATAGTACATCTCAATGAATCTGTAA
AGATTGAGTGCACGAGACCCAATAATAAAACAAGAACAAGTATAAGAATA
GGACCAGGACAAGCATTTTATGCAACAGGACAAGTAATAGGAGACATAAG
AGAAGCACATTGTAACATTAGTGAAAGTAAATGGAATGAAACTTTACAAA
GGGTAAGTAAAAAATTAAAAGAATACTTCCCTCATAAGAATATAACATTT
CAACCATCCTCAGGAGGGGACCTAGAAATTACAACACATAGCTTTAATTG
TGGAGGAGAATTTTTCTATTGCAATACATCAAGCCTGTTTAATAGGACAT
ATATGGCTAATAGTACAGATATGGCTAATAGTACAGAAACTAACAGTACA
CGAACCATCACAATCCGCTGCAGAATAAAACAAATTATAAACATGTGGCA
GGAGGTGGGACGAGCAATGTATGCCCCTCCCATTGCAGGAAACATAACAT
GTATATCAAATATCACAGGACTACTATTGACAAGGGATGGAGGAAAAAAC
AATACGGATACGGAGACATTCAGACCTGGAGGAGGAAATATGAAGGACAA
TTGGAGAAGTGAATTATATAAATATAAAGTGGTAGAAGTTAAGCCATTAG
GAGTAGCACCCACTAATGCAAGAAGGAGAGTGGTGGAGAGAGAAAAAAGA
GCAGTGGGAATGGGAGCTGTGTTCCTTGGGTTCTTGGGAGCGGCAGGAAG
CACTATGGGCGCAGCATCAATAACGCTGACGGTACAGGCCAGACAATTAT
TGTCTGGTATAGTGCAACAGCAAAGCAATTTGCTGAAGGCTATAGAGGCT
CAACAGCATATGTTGAAACTCACGGTCTGGGGCATTAAACAGCTCCAGGC
AAGAGTCCTGGCCTTGGAAAGATACCTAAAGGATCAACAGCTCCTAGGGA
TGTGGGCTGCTCTGGAAAACTCATCTGCACCACTAATGTATATTGGAAC
TCTAGTTGGAGTAATAAAACTTATGGTGATATTTGGGATAACATGACCTG
GATGCAGTGGGAGAGAGAAATTAGCAATTATACAGAAATAATATATGAAT
TGCTTGAAGAATCACAAAACCAGCAGGAAAAGAATGAACAAGATTTACTA
GCATTGGACAGATGGAACAATCTGTGGAATTGGTTTAACATAACAAATTG
GCTGTGGTATATAAAAATATTCATAATGATAGTAGGAGGCTTGATAGGTT
TAAGAATAATTTTTGCTGTGCTTTCTTTAGTAAATAGAGTTAGGCAGGGA
TACTCACCTCTGTCGTTGCAGACCCTTATCCCAAGCCCGAGGGGACCAGA
CAGGCCCGGAGGAATCGAAGAAGAAGGTGGAGAGCAAGACAGAAACAGAT
CAACGCGATTAGTGAGCGGATTCTTAGCGCTTGTCTGGGACGACCTGCGG
AGCCTGTGCCTTTTCATCTACCACCGATTGAGAGACTTCATATTAATTGC
AGCGAGAGCGGGGGAACTTCTGGGACGCAGCAGTCTCAAGGGACTACGGA
GAGGATGGGAAGCCCTTAAGTATCTGGGAAGTCTTGTGCAGTATTGGGGC
CTGGAACTAAAAAGGAGTGCTATTAGTCTATTGGATACCCTAGCAATAGC
AGTAGGTGAAGGAACAGATAGGATTCTAGAATTTGTATTAGGAATTTGTA
GAGCTATCCGCAACATACCTACAAGAATAAGACAGGGCTTTGAAACAGCT
TTGCTATAA

>w030.21
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTACCAATG
CTACTGCCAGCAATAGCAGTATAATAGGGAAATGAAAAATTGCTCTTTC
AATATAACCACAGAATTAAGAGATAAGAGAGAGAAAAAGAATGCACTTTT
TTATAAACTTGATATAGTACAACTAGATGGCAACTCTAGTCAGTATAGAT
TAATAAATTGTAATACCTCAGTCATAACACAAGCCTGTCCAAAGGTCTCT
TTTGACCCAATTCCTATACATTATTGTGCTCCAGCTGGTTATGCGATTCT
AAAGTGTAATAATAAGACATTCACTGGAACAGGACCGTGTAATAATGTCA
```

Fig. 15 (cont.)
GCACAGTACAATGTACACATGGAATTAAGCCAGTGGTTTCAACTCAATTA
TTGTTAAATGGTAGCCTAGCAGAAGGAGAGATAATAATTAGATCTGAAAA
TATAACAAACACTGCCAAAACAATAATAGTACATCTCAATGAATCTGTAA
AGATTGAGTGTACGAGACCCAATAATAAAACAAGAACAAGTATAAGAATA
GGACCAGGACAAGCATTTTATGCAACAGGACAAGTAATAGGAGACATAAG
AGAAGCATATTGTAACATTAGTGAAAGTAAATGGAATGAAACTTTACAAA
GGGTAAGTAAAAAATTAAAAGAATACTTCCCTCATAAGAATATAACATTT
CAACCATCCTCAGGAGGGGACCTAGAAATTACAACACATAGCTTTAATTG
TGGAGGAGAATTTTTCTATTGCAATACATCAAGCCTGTTTAATAGGACAT
ATATGGCTAATAGTACAGATATGGCTAATAGTACAGAAACTAACAGTACA
CGAACCATCACAATCCGCTGCAGAATAAAACAAATTATAAACATGTGGCA
GGAGGTGGGACGAGCAATGTATGCCCCTCCCATTGCAGGAAACATAACAT
GTATATCAAATATCACAGGACTACTATTGACAAGGGATGGAGGAGAAAAC
AATACGGAGACATTCAGACCTGGAGGAGGAAATATGAAGGACAATTGGAG
AAGTGAATTATATAAATATAAAGTGGTAGAAGTTAAGCCATTAGGAGTAG
CACCCACTAATGCAAGAAGGAGAGTGGTGGAGAGAGAAAAAAGAGCAGTG
GGAATGGGAGCTGTGTTCCTTGGGTTCTTGGGAGCGGCAGGAAGCACTAT
GGGCGCAGCATCAATAACGCTGACGGTACAGGCCAGACAATTATTGTCTG
GTATAGTGCAACAGCAAAGCAATTTGCTGAAGGCTATAGAGGCTCAACAG
CATATGTTGAAACTCACGGTCTGGGGCATTAAACAGCTCCAGGCAAGAGT
CCTGGCCTTGGAAAGATACCTAAAGGATCAACAGCTCCTAGGGATGTGGG
GCTGCTCTGGAAAACTCATCTGCACCACTAGTGTATATTGGAACTCTAGT
TGGAGTAATAAAACTTATGGTGATATTTGGGATAACATGACCTGGATGCA
GTGGGAGAGAGAAATTAGCAATTATACAGAAATAATATATGAATTGCTTG
AAGAATCACAAAACCAGCAGGAAAAGAATGAACAAGATTTACTAGCATTG
GACAGATGGAACAGTCTGTGGAATTGGTTTAACATAACAAATTGGCTGTG
GTATATAAAAATATTCATAATGATAGTAGGAGGCTTGATAGGTTTAAGAA
TAATTTTTGCTGTGCTTTCTTTAGTAAATAGAGTTAGGCAGGGATACTCA
CCTCTGTCGTTGCAGACCCTTATCCCAAGCCCGAGGGGACCAGACAGGCC
CGGAGGAATCGAAGAAGAAGGTGGAGAGCAAGACAGAAACAGATCAACGC
GATTAGTGAGCGGATTCTTAGCGCTTGTCTGGGACGACCTGCGGAGCCTG
TGCCTTTTCATCTACCACCGATTGAGAGACTTCATATTAATTGCAGCGAG
AGCGGGGGAACTTCTGGGACGCAGCAGTCTCAAGGGACTACGGAGAGGAT
GGGAAGCCCTTAAGTATCTGGGAAGTCTTGTGCAGTATTGGGGCCTGGAA
CTAAAAGGAGTGCTATTAGTCTATTGGATACCCTAGCAATAGCAGTAGG
TGAAGGAACAGATAGGATTCTAGAATTTGTATTAGGAATTTGTAGAGCTA
TCCGCAACATACCTACAAGAATAAGACAGGGCTTTGAAACAGCTTTGCTA
TAA >w030.18
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAATG
CTACTGCCAGCAATAGCAGTATAATAGGGGAATGAAAAATTGCTCTTTC
AATATAACCACAGAATTAAGAGATAAGAGAGAGAAAAAGAATGCACTTTT
TTATAAACTTGATATAGTACAACTAGATGGCAACTCTAGTCAGTATAGAT
TAATAAATTGTAATACCTCAGTCATAACACAAGCCTGTCCAAAGGTCTCT
TTTGACCCAATTCCTATACATTATTGTGCTCCGGCTGGTTATGCGATTCT
AAAGTGTAATAATAAGACATTCACTGGAACAGGACCGTGTAATAATGTCA
GCACAGTACAATGTACACATGGAATTAAGCCAGTGGTTTCAACTCAACTA
TTGTTAAATGGTAGCCTAGCAGAAGGAGAGATAATAATTAGATCTGAAAA
TATAACAAACAATGCCAAAACAATAATAGTACATCTCAATGAATCTGTAA
AGATTGAGTGTACGAGACCCAATAATAAAACAAGAACAAGTATAAGAATA Fig. 15 (cont.)
GGACCAGGACAAGCATTTTATGCAACAGGACAAGTAATAGGAGACATAAG
AGAAGCATATTGTAACATTAGTGAAAGTAAATGGAATGAAACTTTACAAA
GGGTAAGTAAAAAATTAAAAGAATACTTCCCTCATAAGAATATAACATTT
CAACCATCCTCAGGAGGGGACCTAGAAATTACAACACATAGCTTTAATTG
TGGAGGAGAATTTTTCTATTGCAATACATCAAGCCTGTTTAATAGGACAT
ATATGGCTAATAGTACAGATATGGCTAATAGTACAGAAACTAACAGTACA
CGAATCATCACAATCCACTGCAGAATAAAACAAATTATAAACATGTGGCA
GGAGGTGGGACGAGCAATGTATGCCCCTCCCATTGCAGGAAACATAACAT
GTATATCAAATATCACAGGACTACTATTGACAAGGGATGGAGGAAAAAAC
AATCCGGAGACATTCAGACCTGGAGGAGGAAATATGAAGGACAATTGGAG
AAGTGAATTATATAAATATAAAGTGGTAGAAGTTAAGCCATTAGGAGTAG
CACCCACTAATGCAAGAAGGAGAGTGGTGGAGAGAGAAAAAAGAGCAGTG
GGTTTGGGAGCTGTGTTCCTTGGGTTCTTGGGAGCGGCAGGAAGCACTAT
GGGCGCAGCATCAATAACGCTGACGGTACAGGCCAGACAATTATTGTCTG
GTATAGTGCAACAGCAAAGCAATTTGCTGAAGGCTATAGAGGCTCAACAG
CATATGTTGAAACTCACGGTCTGGGGCATTAAACAGCTCCAGGCAAGAGT
CCTGGCCTTGGAAAGATACCTAAAGGATCAACAGCTCCTAGGGATGTGGG
GTTGCTCTGGAAAACTCATCTGCACCACTAATGTATATTGGAACTCTAGT
TGGAGTAATAAAACTTATGGTGATATTTGGGATAACATGACCTGGATGCA
GTGGGAGAGAGAAATTAGCAATTATACAGAAATAATATATGAATTGCTTG
AAGAATCACAAAACCAGCAGGAAAAGAATGAACAAGATTTACTAGCATTG
GACAGATGGAACAGTCTGTGGAATTGGTTTAACATAACAAATTGGCTGTG
GTATATAAAAATATTCATAATGATAGTAGGAGGCTTGATAGGTTTAAGAA
TAATTTTTGCTGTGCTTTCTTTAGTAAATAGAGTTAGGCAGGGATACTCA
CCTCTGTCGTTGCAGACCCTTATCCCAAGCCCGAGGGGACCAGACAGGCC
CGGAGGAATCGAAGAAGAAGGTGGAGAGCAAGACAGAAACAGATCAACGC
GATTAGTGAGCGGATTCTTAGCGCTTGTCTGGGACGACCTGCGGAGCCTG
TGCCTTTTCATCTACCACCGATTGAGAGACTTCATATTAATTGCAGCGAG
AGCGGGGGAACTTCTGGGACGCAGCAGTCTCAAGGGACTACGGAGAGGAT
GGGAAGCCCTTAAGTATCTGGGAAGTCTTGTGCAGTATTGGGGCCTGGAA
CTAAAAAGGAGTGCTATTAGTCTATTGGATACCCTAGCAATAGTAGTAGG
TGAAGGAACAGATAGGATTCTAGAATTTGTATTAGGAATTTGTAGAGCTA
TCCGCAACATACCTACAAGAATAAGACAGGGCTTTGAAACAGCTTTGCTA
TAA >w030.9
ATGAGAGTAATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCCCTCTGTGTCACTCTAAACTGTACCAATGCTACTGCCAATG
CTACTGCCAGCAATAGCAGTATAATAGAGGGAATGAAAAATTGCTCTTTC
AATATAACCACAGAATTAAGAGATAAGAGAGAGAAAAAGAATGCACTTTT
TTATAAACTTGATATAGTACAACTAGATGGCAACTCTAGTCAGTATAGAT
TAATAAATTGTAATACCTCTGTCAACACAAGCCTGTCCAAAGGTCTCT
TTTGACCCAATTCCTATACATTATTGTGCTCCAGCTGGTTATGCGGATTCT
AAAGTGTAATAATAAGACATTCAATGGAACAGGACCGTGTAATAATGTTA
GCACAGTACAATGTACACATGGAATTAAGCCAGTGGTTTCAACTCAACTA
TTGTTAAATGGTAGCCTAGCAGAAGGAGAGATAATAATTAGATCTGAAAA
TATAACAAACAATGTCAAAACAATAATAGTACATCTCAATGAATCTGTAA
AGATTGAGTGTACGAGACCCAATAATAAAACAAGAACAAGTATAAGAATA
GGACCAGGACAAGCATTTTATGCAACAGGACAAGTAATAGGAGACATAAG
AGAAGCACATTGTAACATTAGTGAAAGTAAATGGAATAAAACTTTACAAA
GGGTAAGTAAAAAATTAAAAGAATACTTCCCTCATAAGAATATAACATTT
CAACCATCCTCAGGAGGGGACCTAGAAATTACAACACATAGCTTTAATTG Fig. 15 (cont.)
TGGAGGAGAATTTTTCTATTGCAATACATCAAGCCTGTTTAATAGGACAT
ATATGGCTAATAGTACAGATATGGCTAATAGTACAGAAACTAACAGTACA
CGAACCATCACAATCCGCTGCAGAATAAAACAAATTATAAACATGTGGCA
GGAGGTGGGACGAGCAATGTATGCCCCTCCCATTGCAGGAAACATAACAT
GTATATCAAATATCACAGGACTACTATTGACAAGGGATGGAGGAAAAAAC
AATACGGATACGGAGACATTCAGACCTGGAGGAGGAAATATGAAGGACAA
TTGGAGAAGTGAATTATATAAATATAAAGTGGTAGAAGTTAAGCCATTAG
GAGTAGCACCCACTAATGCAAGAAGGAGAGTGGTGGAGAGAGAAAAAAGA
GCAGTGGGAATGGGAGCTGTGTTCCTTGGGTTCTTGGGAGCGGCAGGAAG
CACTATGGGCGCAGCATCAATAACGCTGACGGTACAGGCCAGACAATTAT
TGTCTGGTATAGTGCAACAGCAAAGCAATTTGCTGAAGGCTATAGAGGCT
CAACAGCATATGTTGAAACTCACGGTCTGGGGCATTAAACAGCTCCAGGC
AAGAGTCCTGGCCTTGGAAAGATACCTAAAGGATCAACAGCTCCTAGGGA
TGTGGGGCTGCTCTGGAAAACTCATCTGCACCACTAATGTATATTGGAAC
TCTAGTTGGAGTAATAAAACTTATGGTGATATTTGGGATAACATGACCTG
GATGCAGTGGGAGAGAGAATTAGCAATTATACAGAAATAATATATGAAT
TGCTTGAAGAATCACAAAACCAGCAGGAAAAGAATGAACAAGATTTACTA
GCATTGGACAGATGGAACAGTCTGTGGAATTGGTTTAACATAACAAATTG
GCTGTGGTATATAAAAATATTCATAATGATAGTAGGAGGCTTGATAGGTT
TAAGAATAATTTTTGCTGTGCTTTCTTTAGTAAATAGAGTTAGGCAGGGA
TACTCACCTCTGTCGTTACAGACCCTTATCCCAAGCCCGAGGGGACCAGA
CAGGCCCGGAGGAATCGAAGAAGAAGGTGGAGAGCAAGACAGAAACAGAT
CAACGCGATTAGTGAGCGGATTCTTAGCGCTTGTCTGGGACGACCTGCGG
AGCCTGTGCCTTTTCATCTACCACCGATTGAGAGACTTCATATTAATTGC
AGCGAGAGCGGGGGAACTTCTGGGACGCAGCAGTCTCAAGGGACTACGGA
GAAGATGGGAAGCCCTTAAGTATCTGGGAAGTCTTGTGCAGTATTGGGGC
CTGGAACTAAAAAGGAGTGCTATTAGTCTATTGGATACCCTAGCAATAGC
AATAGGTGAAGGAACAGATAGGATTCTAGAATTTGTATTAGGAATTTGTA
GAGCTATCCGCAACATACCTACAAGAATAAGACAGGGCTTTGAAACAGCT
TTGCTATAA >w030.36
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCCCTCTGTGTCACTCTAAACTGTACCAATGCTACTGCCAATG
CTACTGCCAGCAATAGCAGTATAATAGAGGGAATGAAAAATTGCTCTTTC
AATATAACCACAGAATTAAGAGATAAGAGAGAGAAAAAGAATGCACTTTT
TTATAAACTTGATATAGTACAACTAGATGGCAACTCTAGTCAGTATAGAT
TAATAAATTGTAATACCTCAGTCATAACACAAGCCTGTCCAAAGGTCTCT
TTTGACCCAATTCCTATACATTATTGTGCTCCAGCTGGTTATGCGATTCT
AAAGTGTAATAATAAGACATTCAATGGAACAGGACCGTGTAATAATGTCA
GCACAGTACAATGTACACATGGAATTAAGCCAGTGGTTTCAACTCAACTA
TTGTTAAATGGTAGCCTAGCAGAAGGAGAGATAATAATTAGATCTGAAAA
TATAACAAACAATGTCAAAACAATAATAGTACATCTCAATGAATCTGTAA
AGATTGAGTGTACGAGACCCAATAATAAAACAAGAACAAGTATAAGAATA
GGACCAGGACAAGCATTTTATGCAACAGGACAAGTAATAGGAGACATAAG
AGAAGCATATTGTAACATTAGTGAAAGTAAATGGAATGAAACTTTACAAA
GGGTAAGTAAAAAATTAAAAGAATACTTCCCTCATAAGAATATAACATTT
CAACCATCCTCAGGAGGGGACCTAGAAATTACAACACATAGCTTTAATTG
TGGAGGAGAATTTTTCTATTGCAATACATCAAGCCTGTTTAATAGGACAT
ATATGGCTAATAGTACAGATATGGCTAATAGTACAGAAACTAACAGTACA
CGAACCATCAAAATCCACTGCAGAATAAAACAAATTATAAACATGTGGCA
GGAGGTGGGACGAGCAATGTATGCCCCTCCCATTGCAGGAAACATAACAT Fig. 15 (cont.)
GTATATCAAATATCACAGGACTACTATTGACAAGGGATGGAGGAAAAAAC
AATACGGATACGGAGACATTCAGACCTGGAGGAGGAAATATGAAGGACAA
TTGGAGAAGTGAATTATATAAATATAAAGTGGTAGAAGTTAAGCCATTAG
GAGTAGCACCCACTAATGCAAGAAGGAGAGTGGTGGAGAGAGAAAAAAGA
GCAGTGGGAATGGGAGCTGTGTTCCTTGGGTTCTTGGGAGCGGCAGGAAG
CACTATGGGCGCAGCATCAATAACGCTGACGGTACAGGCCAGACAATTAT
TGTCTGGTATAGTGCAACAGCAAAGCAATTTGCTGAAGGCTATAGAGGCT
CAACAGCATATGTTGAAACTCACGGTCTGGGGCATTAAACAGCTCCAGGC
AAGAGTCCTGGCCTTGGAAAGATACCTAAAGGATCAACAGCTCCTAGGGA
TGTGGGGCTGCTCTGGAAAACTCATCTGCACCACTAATGTATATTGGAAC
TCTAGTTGGAGTAATAAAACTTATGGTGATATTTGGGATAACATGACCTG
GATGCAGTGGGAGAGAGAAATTAGCAATTATACAGAAATAATATATGAAT
TGCTTGAAGAATCACAAAACCAGCAGGAAAAGAATGAACAAGATTTACTA
GCATTGGACAGATGGAACAGTCTGTGGAATTGGCTTAACATAACAAATTG
GCTGTGGTATATAAAAATATTCATAATGATAGTAGGAGGCTTGATAGGTT
TAAGAATAATTTTTGCTGTGCTTTCTTTAGTAAATAGAGTTAGGCAGGGA
TACTCACCTCTGTCGTTACAGACCCTTATCCCAAGCCCGAGGGGACCAGA
CAGGCCCGGAGGAATCGAAGAAGAAGGTGGAGAGCAAGACAGAAACAGAT
CAACGCGATTAGTGAGCGGATTCTTAGCGCTTGTCTGGGACGACCTGCGG
AGCCTGTGCCTTTTCATCTACCACCGATTGAGAGACTTCATATTAATTGC
AGCGAGAGCGGGGGAACTTCTGGGACGCAGCAGTCTCAAGGGACTACGGA
GAGGATGGGAAGCCCTTAAGTATCTGGGAAGTCTTGTGCAGTATTGGGGC
CTGGAACTAAAAAGGAGTGCTATTAGTCTATTGGATACCCTAGCAATAGC
AGTAGGTGAAGGAACAGATAGGATTCTAGAATTTGTATTAGGAATTTGTA
GAGCTATCCGCAACATACCTACAAGAATAAGACAGGGCTTTGAAACAGCT
TTGCTATAA >w030.5
ATGAGAGTGATGGGGATACAGAGGAATTATCCACAATGGTGGATATGGAG
CATGTTAGGCTTTTGGATGCTAATGATTTGTAACGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAATG
CTACTGCCAGCAATAGCAGTATAATAGAGGGAATGAAAAATTGCTCTTTC
AATATAACCACAGAATTAAGAGATAAGAGAGAAAAGAATGCACTTTTT
TTATAAACTTGATATAGTACAACTAGATGGCAACTCTAGTCAGTATAGAT
TAATAAATTGTAATACCTCAGTCATAACACAAGCCTGTCCAAAGGTCTCT
TTTGACCCAATTCCTATACATTATTGTGCTCCAGCTGGTTATGCGATTCT
AAAGTGTAATAATAAGACATTCACTGGAACAGGACCGTGTAATAATGTCA
GCACAGTACAATGTACACATGGAATTAAGCCAGTGGTTTCAACTCAACTA
TTGTTAAATGGTAGCCTAGCAGAAGGAGAGATAATAATTAGATCTGAAAA
TATAACAAACAATGGCAAAACAATAATAGTACAACTCAATGAATCTGTAA
AGATTGAGTGTACGAGACCCAATAATAAAACAAGAACAAGTATAAGAATA
GGACCAGGACAAGCATTTTATGCAACAGGACAAGTAATAGGAAACATAAG
AGAAGCATATTGTAACATTAGTGAAAGTAAATGGAATGAAACTTTACAAA
GGGTAAGTAAAAAATTAAAAGAATACTTCCCTCATAAGAATATAACATTT
CAACCATCCTCAGGAGGGGACCTAGAAATTACAACACATAGCTTTAATTG
TGGAGGAGAATTTTTCTATTGCAATACATCAAGCCTGTTTAATAGGACAT
ATATGGCTAATAGTACAGATATGGCTAATAGTACAGAAACTAACAGTACA
CGAATCATCACAATCCACTGCAGAATAAAACAAATTATAAACATGTGGCA
GGAGGTGGGACGAGCAATGTATGCCCCTCCCATTGCAGGAAACATAACAT
GTATATCAAATATCACAGGACTACTATTGACAAGGGATGGAGGAAAAAAC
AATACGGATACGGAGACATTCAGACCTGGAGGAGGAAATATGAAGGACAA
TTGGAGAAGTGAATTATATAAATATAAAGTGGTAGAAGTTAAGCCATTAG
GAGTAGCACCCACTAATGCAAGAAGGAGAGTGGTGGAGAGAGAAAAAAGA Fig. 15 (cont.)
GCAGTGGGAATGGGAGCTGTGTTCCTTGGGTTCTTGGGAGCGGCAGGAAG
CACTATGGGCGCAGCATCAATAACGCTGACGGTACAGGCCAGACAATTAT
TGTCTGGTATAGTGCAACAGCAAAGCAATTTGCTGAAGGCTATAGAGGCT
CAACAGCATATGTTGAAACTCACGGTCTGGGGCATTAAACAGCTCCAGGC
AAGAGTCCTGGCCTTGGAAAGATACCTAAAGGATCAACAGCTCCTAGGGA
TGTGGGGCTGCTCTGGAAAACTCATCTGCACCACTAATGTATATTGGAAC
TCTAGTTGGAGTAATAAAACTTATGGTGATATTTGGGATAACATGACCTG
GATGCAGTGGGAGAGAGAAATTAGCAATTATACAGAAATAATATATGAAT
TGCTTGAAGAATCACAAAACCAGCAGGAAAAGAATGAACAAGATTTACTA
GCATTGGACAGATGGAACAGTCTGTGGAATTGGTTTAACATAACAAATTG
GCTGTGGTATATAAAAATATTCATAATGATAGTAGGAGGCTTGATAGGTT
TAAGAATAATTTTTGCTGTGCTTTCTTTAGTAAATAGAGTTAGGCAGGGA
TACTCACCTCTGTCGTTGCAGACCCTTATCCCAAGCCCGAGGGGACCAGA
CAGGCCCGGAGGAATCGAAGAAGAAGGTGGAGAGCAAGACAGAAACAGAT
CAACGCGATTAGTGAGCGGATTCTTAGCGCTTGTCTGGGACGACCTGCGG
AGCCTGTGCCTTTTCATCTACCACCGATTGAGAGACTTCATATTAATTGC
AGCGAGAGCGGGGGAACTTCTGGGACGCAGCAGTCTCAAGGGACTACGGA
GAGGATGGGAAGCCCTTAAGTATCTGGGAAGTCTTGTGCAGTATTGGGGC
CTGGAACTAAAAAGGAGTGCTATTAGTCTATTGGATACCCTAGCAATAGC
AGTAGGTGAAGGAACAGATAGGATTCTAGAATTTGTATTAGGAATTTGTA
GAGCTATCCGCAACATACCTACAAGAATAAGACAGGGCTTTGAAACAGCT
TTGCTATAA >w030.27
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATGCTACTGCCAGCAATAGCAGTATAATAGGGAATGAAAAATTGCTCT
TTCAATATAACCACAGAATTAAGAGATAAGAGAGAGAAAAGAATGCACT
TTTTTATAAACTTGATATAGTACAACTAGATGGCAACTCTAGTCAGTATA
GATTAATAAATTGTAATACCTCAGTCATAACACAAGCCTGTCCAAAGGTC
TCTTTTGACCCAATTCCTATACATTATTGTGCTCCAGCTGGTTATGCGAT
TCTAAAGTGTAATAATAAGACATTCACTGGAACAGGACCGTGTAATAATG
TCAGCACAGTACAATGTACACATGGAATTAAGCCAGTGGTTTCAACTCAA
CTATTGTTAAATGGTAGCCTAGCAGAAGGAGAGTAATAATTAGATCTGA
AAATATAACAAACAATGTCAAAACAATAATAGTACATCTCAATGAATCTG
TAAAGATTGAGTGTACGAGACCCAATAATAAAACAAGAACAAGTATAAGA
ATAGGACCAGGACAAGCATTTTATGCAACAGGACAAGTAATAGGAAACAT
AAGAGAAGCATATTGTAACATTAGTGAAAGTAAATGGAATGAAACTTTAC
AAAGGGTAAGTAAAAAATTAAAAGAATACTTCCCTCATAAGAATATAACA
TTTCAACCATCCTCAGGAGGGGACCTAGAAATTACAACACATAGCTTTAA
TTGTGGAGGAGAATTTTTCTATTGCAATACATCAAGCCTGTTTAATAGGA
CATATATGGCTAATAGTACAGATATGGCTAATAGTACAGAAACTAACAGT
ACACGAATCATCACAATCCACTGCAGAATAAAACAAATTATAAACATGTG
GCAGGAGGTGGGACGAGCAATGTATGCCCCTCCCATTGCAGGAAACATAA
CATGTATATCAAATATCACAGGACTACTATTGACAAGGGATGGAGGAAAA
AACAATACGGATACGGAGACATTCAGACCTGGAGGAGGAAATATGAAGGA
CAATTGGAGAAGTGAATTATATAAATATAAAGTGGTAGAAGTTAAGCCAT
TAGGAGTAGCACCCACTAATGCAAGAAGGAGAGTGGTGGAGAGAGAAAAA
AGAGCAGTGGGAATGGGAGCTGTGTTCCTTGGGTTCTTGGGAGCGGCAGG
AAGCACTATGGGCGCAGCATCAATAACGCTGACGGTACAGGCCAGACAAT
TATTGTCTGGTATAGTGCAACAGCAAAGCAATTTGCTGAAGGCTATAGAG
GCTCAACAGCATATGTTGAAACTCACGGTCTGGGGCATTAAACAGCTCCA Fig. 15 (cont.)
GGCAAGAGTCCTGGCCTTGGAAAGATACCTAAAGGATCAACAGCTCCTAG
GGATGTGGGGCTGCTCTGGAAAACTCATCTGCACCACTAATGTATATTGG
AACTCTAGTTGGAGTAATAAAACTTATGGTGATATTTGGGATAACATGAC
CTGGATGCAGTGGGAGAGAGAAATTAGCAATTATACAGAAATAATATATG
AATTGCTTGAAGAATCACAAAACCAGCAGGAAAAGAATGAACAAGATTTA
CTAGCATTGGACAGATGGAACAGTCTGTGGAATTGGTTTAACATAACAAA
TTGGCTGTGGTATATAAAAATATTCATAATGATAGTAGGAGGCTTGATAG
GTTTAAGAATAATTTTTGCTGTGCTTTCTTTAGTAAATAGAGTTAGGCAG
GGATACTCACCTCTGTCGTTACAGACCCTTATCCCAAGCCCGAGGGGACC
AGACAGGCCCGGAGGAATCGAAGAAGAAGGTGGAGAGCAAGACAGAAACA
GATCAACGCGATTAGTGAGCGGATTCTTAGCGCTTGTCTGGGACGACCTG
CGGAGCCTGTGCCTTTTCATCTACCACCGATTGAGAGACTTCATATTAAT
TGCAGCGAGAGCGGGGGAACTTCTGGGACGCAGCAGTCTCAAGGGACTAC
GGAGAGGATGGGAAGCCCTTAAGTATCTGGGAAGTCTTGTGCAGTATTGG
GGCCTGGAACTAAAAAGGAGTGCTATTAGTCTATTGGATACCCTAGCAAT
AGCAGTAGGTGAAGGAACAGATAGGATTCTAGAATTTGTATTAGGAATTT
GTAGAGCTATCCGCAACATACCTACAAGAATAAGACAGGGCTTTGAAACA
GCTTTGCTATAA >w030.23
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATGCTACTGCCAGCAATAGCAGCATAATAGAGGGAATGAAAAATTGCTCT
TTCAATATAACCACAGAATTAAGAGATAAGAGGAGAAAAGAATGCACT
TTTTTATAAACTTGATATAGTACAACTAGATGGCAACTCTAGTCAGTATA
GATTAATAAATTGTAATACCTCAGTCATAACACAAGCCTGTCCAAAGGTC
TCTTTTGACCCAATTCCTATACATTATTGTGCTCCAGCTGGTTATGCGAT
TCTAAAGTGTAATAATAAGACATTCACTGGAACAGGACCGTGTAATAATG
TCAGCACAGTACAATGTACACATGGAATTAAGCCAGTGGTTTCAACTCAA
CTATTGTTAAATGGTAGCCTAGCAGAAGGAGAGATAATAATTAGATCTGA
AAATATAACAAACAATGGCAAAACAATAATAGTACATCTCAATGAATCTG
TAAAGATTGAGTGTACGAGACCCAGTAATAAAACAAGAACAAGTATAAGA
ATAGGACCAGGACAAGCATTTTATGCAACAGCAAGTAATAGGAGACAT
AAGAGAAGCACATTGTAACATTAGTGAAAGTAAATGGAATGAAACTTTAC
AAAGGGTAAGTAAAAAATTAAAAGAATACTTCCCTCATAAGAATATAACA
TTTCAACCATCCTCAGGAGGGGACCTAGAAATTACAACACATAGCTTTAA
TTGTGGAGGAGAATTTTTCTATTGCAATACATCAAGCCTGTTTAATAGGA
CATATATGGCTAATAGTACAGATATGGCTAATAGTACAGAAACTAACAGT
ACACGAACCATCACACTCCACTGCAGAATAAAACAAATTATAAACATGTG
GCAGGAGGTGGGACGAGCAATGTATGCCCCTCCCATTGCAGGAAACATAA
CATGTATATCAAATATCACAGGACTACTATTGACAAGGGATGGAGGAAAA
AACAATACGGATACGGAGACATTCAGACCTGGAGGAGGAAATATGAAGGA
CAATTGGAGAAGTGAATTTATAAATATAAAGTGGTAGAAGTTAAGCCAT
TAGGAGTAGCACCCACTAATGCAAGAAGGAGAGTGGTGGAGAGAGAAAA
AGAGCAGTGGGAATGGGAGCTGTGTTCCTTGGGTTCTTGGGAGCGGCAGG
AAGCACTATGGGCGCAGCATCAATAACGCTGACGGTACAGGCCAGACAAT
TATTGTCTGGTATAGTGCAACAGCAAAGCAATTTGCTGAAGGCTATAGAG
GCTCAACAGCATATGTTGAAACTCACGGTCTGGGGCATTAAACAGCTCCA
GGCAAGAGTCCTGGCCTTGGAAAGATACCTAAAGGATCAACAGCTCCTAG
GGATGTGGGGCTGCTCTGGAAAACTCATCTGCACCACTAATGTATATTGG
AACTCTAGTTGGAGTAATAAAACTTATGGTGATATTTGGGATAACATGAC
CTGGATGCAGTGGGAGAGAGAAATTAGCAATTATACAGAAATAATATATG Fig. 15 (cont.)
AATTGCTTGAAGAATCACAAAACCAGCAGGAAAAGAATGAACAAGATTTA
CTAGCATTGGACAGATGGAACAGTCTGTGGAATTGGTTTAACATAACAAA
TTGGCTGTGGTATATAAAAATATTCATAATGATAGTAGGAGGCTTGATAG
GTTTAAGAATAATTTTTGCTGTGCTTTCTTTAGTAAATAGAGTTAGGCAG
GGATACTCACCTCTGTCGTTACAGACCCTTATCCCAAGCCCGAGGGGACC
AGACAGGCCCGGAGGAATCGAAGAAGAAGGTGGAGAGCAAGACAGAAACA
GATCAACGCGATTAGTGAGCGGATTCTTAGCGCTTGTCTGGGACGACCTG
CGGAGCCTGTGCCTTTTCATCTACCACCGATTGAGAGACTTCATATTAAT
TGCAGCGAGAGCGGGGGAACTTCTGGGACGCAGCAGTCTCAAGGGACTAC
GGAGAGGATGGGAAGCCCTTAAGTATCTGGGAAGTCTTGTGCAGTATTGG
GGCCTGGAACTAAAAAGGAGTGCTATTAGTCTATTGGATACCCTAGCAAT
AGCAGTAGGTGAAGGAACAGATAGGATTCTAGAATTTGTATTAGGAATTT
GTAGAGCTATCCGCAACATACCTACAAGAATAAGACAGGGCTTTGAAACA
GCTTTGCTATAA >w030.15
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGGTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATGCTACTGCCAGCAATAGCAGTATAATAGGGAATGAAAAATTGCTCT
TTCAATATAACCACAGAATTAAGAGATAAGAGAGAGAAAAAGAATGCACT
TTTTTATAAACTTGATATAGTACAACTAGATGGCAACTCTAGTCAGTATA
GATTAATAAATTGTAATACCTCAGTCATAACACAAGCCTGTCCAAAGGTC
TCTTTTGACCCAATTCCTATACATTATTGTGCTCCAGCTGGTTATGCGAT
TCTAAAGTGTAATAATAAGACATTCACTGGAACAGGACCGTGTAATAATG
TCAGCACAGTACAATGTACACATGGAACTTAAGCCAGTGGTTTCAACTCAA
CTATTGTTAAATGGTAGCCTAGCAGAAGGAGAGATAATAATTAGATCTGA
AAATATAACAAACAATGGCAAAACAATAATAGTACATCTCAATGAATCTG
TAAAGATTGAGTGTACGAGACCCAATAATAAAACAAGAACAAGTATAAGA
ATAGGACCAGGACAAGCATTTTATGCAACAGGACAAGTAATAGGAGACAT
AAGAGAAGCACATTGTAACATTAGTGAAAGTAAATGGAATGAAACTTTAC
AAAGGGTAAGTAAAAAATTAAAAGAATACTTCCCTCATCAGAATATAACA
TTTCAACCATCCTCAGGAGGGGACCTAGAAATTACAACACATAGCTTTAA
TTGTGGAGGAGAATTTTTCTATTGCAATACATCAAGCCTGTTTAATAGGA
CATATATGGCTAATAGTACAGATATGGCTAATGTACAGAAACTAACAGT
ACACGAACCATCACAATCCGCTGCAGAATAAAACAAATTATAAACATGTG
GCAGGAGGTGGGACGAGCAATGTATGCCCCTCCCATTGCAGGAAACATAA
CATGTATATCAAATATCACAGGACTACTATTGACAAGGGATGGAGGAAAA
AACAATACGGATACGGAGACATTCAGACCTGGAGGAGGAAATATGAAGGA
CAATTGGAGAAGTGAATTATATAAATATAAAGTGGTAGAAGTTAAGCCAT
TAGGAGTAGCACCCACTAATGCAAGAAGGAGAGTGGTGGAGAGAGAAAAA
AGAGCAGTGGGAATGGGAGCTGTGTTCCTTGGGTTCTTGGGAGCGGCAGG
AAGCACTATGGGCGCAGCATCAATAACGCTGACGGTACAGGCCAGACAAT
TATTGTCTGGTATAGTGCAACAGCAAAGCAATTTGCTGAAGGCTATAGAG
GCTCAACAGCATATGTTGAAACTCACGGTCTGGGGCATTAAACAGCTCCA
GGCAAGAGTCCTGGCCTTGGAAAGATACCTAAAGGATCAACAGCTCCTAG
GGATGTGGGCTGCTCTGGAAAACTCATCTGCACCACTAATGTATATTGG
AACTCTAGTTGGAGTAATAAAACTTATGGTGATATTTGGGATAACATGAC
CTGGATGCAGTGGGAGAGAGAAATTAGCAATTATACAGAAATAATATATG
AATTGCTTGAAGAATCACAAAACCAGCAGGAAAAGAATGAACAAGATTTA
CTAGCATTGGACAGATGGAACAGTCTGTGGAATTGGTTTAACATAACAAA
TTGGCTGTGGTATATAAAAATATTCATAATGATAGTAGGAGGCTTGATAG
GTTTAAGAATAATTTTTGCTGTGCTTTCTTTAGTAAATAGAGTTAGGCAG Fig. 15 (cont.)
GGATACTCACCTCTGTCGTTACAGACCCTTATCCCAAGCCCGAGGGGACC
AGACAGGCCCGGAGGAATCGAAGAAGAAGGTGGAGAGCAAGACAGAAACA
GATCAACGCGATTAGTGAGCGGATTCTTAGCGCTTGTCTGGGACGACCTG
CGGAGCCTGTGCCTTTTCATCTACCACCGATTGAGAGACTTCATATTAAT
TACAGCGAGAGCGGGGGAACTTCTGGGACGCAGCAGTCTCAAGGGACTAC
GGAGAGGATGGGAAGCCCTTAAGTATCTGGGAAGTCTTGTGCAGTATTGG
GGCCTGGAACTAAAAAGGAGTGCTATTAGTCTATTGGATACCCTAGCAAT
AGCAGTAGGTGAAGGAACAGATAGGATTCTAGAATTTGTATTAGGAATTT
GTAGAGCTATCCGCAACATACCTACAAGAATAAGACAGGGCTTTGAAACA
GCTTTGCTATAA >w030.10
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTACCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGACAAAACAATAATAGTACATCTCAATGAATCTGTAAAGATTGAGTGTA
CGAGACCCAATAATAACACAAGAACAGTAATAGGACCAGGACAA
GCATTTTATGCAACAGGACAAGTAATAGGAGACATAAGACAAGCATATTG
TAACATTAGTGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAATCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAAATAATATATGAATTGCTTGAAGAATCACAAA
ACCAGCAGGAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTA
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT Fig. 15 (cont.)
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCGTTGCTATAA >w030.28
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GATGACCCCACTCTGTGTCACTCTAAACTGTACCAATGCTACTGCCATCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGACAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCACATTG
TAACATTAGTGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
ATCCGCTGCAGAATAAAACAAATTATAAACATGTGGCAGGAGGTGGGACG
AGCAATGTATGCCCCTCCCATTGCAGGAAACATCATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTAGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
AGTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA Fig. 15 (cont.)
>w030.13
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GATGACCCCACTCTGTGTCACTCTAAACTGTACCAATGCTACTGCCATCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGACAAAACAATAATAGTACATCTCAATGAATCTGTAAAGATTGAGTGTA
CGAGACCCAATAATAAAACAAGAACAAGGTATAAGAATAGGACCAGGACAA
GCATTTTATGCAACAGGACAAGTAATAGGAGACATAAGAGAAGCATATTG
TAACATTAGTGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACGGAAACTAACAATACACGACCCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAATAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTAGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA >w030.19
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT Fig. 15 (cont.)
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGAA
ACTGTACCAATGCTACTGCCAGCAATAGCAGTATAATAGAGGGAATGAAA
AATTGCTCTTTCAATATAACCACAGAATTAAGAGATAAGAGAGAGAAAAA
GAATGCACTTTTTTATAAACTTGATATAGTACAACTAGATGGCAACTCTA
GTCAGTATAGATTAATAAATTGTAATACCTCAGTCATAACACAAGCCTGT
CCAAAGGTCTCTTTTGACCCAATTCCTATACATTATTGTGCTCCAGCTGG
TTATGCGATTCTAAAGTGTAATAATAAGACATTCACTGGAACAGGACCGT
GTAATAATGTCAGCACAGTACAATGTACACATGGAATTAAGCCAGTGGTT
TCAACTCAACTATTGTTAAATGGTAGCCTAGCAGAAGGAGAGATAATAAT
TAGATCTGAAAATATAACAAACAGTGGCAAAACAATAATAGTACATCTCA
ATGAATCTGTAAAGATTGAGTGTACGAGACCCAATAATAAAACAAGAACA
AGTATAAGAATAGGACCAGGACAAGCATTTTATGCAACAGGACAAGTAAT
AGGAGACATAAGAGAAGCATATTGTAACATTAGTGAAAGTAAATGGAATG
AAACTTTACAAAGGGTAAGTAAAAAATTAAAAGAATACTTCCCTCATAAG
AATATAACATTTCAACCATCATCAGGAGGGGACCTAGAAATTACAACACA
TAGCTTTAATTGTGGAGGAGAATTTTTCTATTGCAATACATCAAGCCTGT
TTAATAGGACATATATGGCTAATAGTACAGATATGGCTAATAGTACAGAA
ACTAACAGTACACGAATCATCACAATCCACTGCAGAATAAAACAAATTAT
AAACATGTGGCAGGAGGTGGGACGAGCAATGTATGCCCCTCCCATTGCAG
GAAACATAACATGTATATCAAGTATCACAGGACTACTATTGACAAGGGAT
GGAGGAGAAAACAATACGGAGACATTCAGACCTGGAGGAGGAAATATGAA
GGACAATTGGAGAAGTGAATTATATAAATATAAAGTGGTAGAAGTTAAGC
CATTAGGAGTAGCACCCACTAATGCAAGAAGGAGAGTGGTGGAGAGAGAA
AAAAGAGCAGTGGGAATGGGAGCTGTGTTCCTTGGGTTCTTGGGAGCGGC
AGGAAGCACTATGGGCGCAGCATCAATAACGCTGACGGTACAGGCCAGAC
AATTATTGTCTGGTATAGTGCAACAGCAAAGCAATTTGCTGAAGGCTATA
GAGGCTCAACAGCATATGTTGAAACTCACGGTCTGGGGCATTAAACAGCT
CCAGGCAAGAGTCCTGGCCTTGGAAAGATACCTAAAGGATCAACAGCTCC
TAGGGATGTGGGGCTGCTCTGGAAAACTCATCTGCACCACTAATGTATAT
TGGAACTCTAGTTGGAGTAATAAAACTTATGGTGATATTTGGGATAACAT
GACCTGGATGCAGTGGGAGAGAGAAATTAGCAATTATACAGAAATAATAT
ATGAATTGCTTGAAGAATCACAAAACCAGCAGGAAAAGAATGAACAAGAT
TTACTAGCATTGGACAGATGGAACAGTCTGTGGAATTGGTTTAACATAAC
AAATTGGCTGTGGTATATAAAAATATTCATAATGATAGTAGGAGGCTTGA
TAGGTTTAAGAATAATTTTTGCTGTGTTTTCTTTAGTAAATAGAGTTAGG
CAGGGATACTCACCTCTATCGTTGCAGACCCTTATCCCAAGCCCGAGGGG
ACCAGACAGGCCCGGAGGAATCGAAGAAGAAGGTGGAGAGCAAGACAGAA
ACAGATCAACGCGATTAGTGAGCGGATTCTTAGCGCTTGTCTGGGACGAC
CTGCGGAGCCTGTGCCTTTTCATCTACCACCGATTGAGAGACTTCATATT
AATTGCAGCGAGAGCGGGGGAACTTCTGGGACGCAGCAGTCTCAAGGGAC
TACGGAGAGGATGGGAAGCCCTTAAGTATCTGGGAAGTCTTGTGCAGTAT
TGGGGCCTGGAACTAAAAAGGAGTGCTATTAGTCTATTGGATACCCTAGC
AATAGCAGTAGGTGAAGGAACAGATAGGATTCTAGAATTTGTATTAGGAA
TTTGTAGAGCTATCCGCAACATACCTACAAGAATAAGACAGGGCTTTGAA
ACAGCTTTGCTATAA >w053.3
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA Fig. 15 (cont.)
GTTGACCCCACTCTGTGTCACTCTAAACTGTACCAATGCTACTAATGCTA
CTGCCAGCAATAGCAGTATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGATGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTGAAAATAT
AACAGACAATGGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAGACATAAGAGA
AGCACATTGTAACATTAGTGAAAGTAAATGGAATGAAACTTTACAAAGGG
TAAGTAAAAAATTAAAAGAATACTTCCCTCATAAGAATATAACATTTCAA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTAATAGTACAGAAACTAACAGTACACGAACCATCACACTCCACTGC
AGAATAAAACAAATTATAAACATGTGGCAGGAGGTGGGACGAGCAATGTA
TGCCCCTCCCATTGCAGGAAACATAACATGTATATCAAATATCACAGGAC
TACTATTGACAAGGGATGGAGGAAAAAACAATACGGAGACATTCGAGACA
TTCAGACCTGGAGGAGGAAATATGAAGGACAATTGGAGAAGTGAATTATA
TAAATATAAAGTGGTAGAAGTTAAGCCATTAGGAGTAGCACCTACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGTTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGCAGAAACAGATCAACGCGATTAGTGAGCG
GATTCTTAGCGCTTGCCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGGTGGGAAGCCCTTA
AGTATCTGGGAAGTCTTGTGCAGTATTGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA >w053.29
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCGATGCTACTGCCAGCA
ATGCTACTGCCATCAATAGCAGTATAATAGAGGGAATGAAAAATTGCTCT
TTCAATATAACCACAGAATTAAGAGATAAGAGAGAGAAAAAGAATGCACT
TTTTTATAAACTTGATATAGTACAACTAGATGGCAACTCTAGTCAGTATA
GATTAATAAATTGTAATACCTCAGTCATAACACAAGCCTGTCCAAAGGTC Fig. 15 (cont.)
TCTTTTGACCCAATTCCTATACATTATTGTGCTCCAGCTGGTTATGCGAT
TCTAAAGTGTAATAATAAGACATTCAATGGAACAGGACCGTGTAATAATG
TCAGCACAGTACAATGTACACATGGAATTAAGCCAGTGGTTTCAACTCAA
CTATTGTTAAATGGTAGCCTAGCAGAAGGAGAGATAATAATTAGATCTGA
AAATATAACAAACAATGCCAAAACAATAATAGTACATCTCAATGAATCTG
TAAAGATTGAGTGTACGAGACCCAGTAATAACACAAGAACAAGTATAAGA
ATAGGACCAGGACAAGCATTTTATGCAACAGGACAAGTAATAGGAGACAT
AAGAGAAGCACATTGTAACATTAGTGAAAGTAAATGGAATGAAACTTTAC
AAAGGGTAAGTAAAAAATTAAAAGAATACTTCCCTCATAAGAATATAACA
TTTCAACCATCCTCAGGAGGGGACCTAGAAATTACAACACATAGCTTTAA
TTGTGGAGGAGAATTTTTCTATTGCAATACATCAAGCCTGTTTAATAGGA
CATATATGGCTAATAGTACAGAAACTAACAGTACACGAATCATCACAATC
CGCTGCAGAATAAAACAAATTATAAACATGTGGCAGGAGGTGGGACGAGC
AATGTATGCCCCTCCCATTGCAGGAAACATAACATGTATATCAAATATCA
CAGGACTACTATTGACAAGGGATGGAGGAAAAAACAATACGGAGACATTC
GAGACATTCAGACCTGAAGGAGGAAATATGAAGGACAATTGGAGAAGTGA
ATTATATAAATATAAAGTGGTAGAAGTTAAGCCATTAGGAGTAGCACCCA
CTAATGCAAGAAGGAGAGTGGTGGAGAGAGAAAAAAGAGCAGTGGGAATG
GGAGCTGTGTTCCTTGGGTTCTTGGGAGCGGCAGGAAGCACTATGGGCGC
AGCATCAATAACGCTGACGGTACAGGCCAGACAATTATTGTCTGGTATAG
TGCAACAGCAAAGCAATTTGCTGAAGGCTATAGAGGCTCAACAGCATATG
TTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCT
CTGGAAAACTCATCTGCACCACTAATGTATATTGGAACTCTAGTTGGAGT
AATAAAACTTATGGTGATATTTGGGATAACATGACCTGGATGCAGTGGGA
GAGAGAAATTAGCAATTATACAGAAATAATATATGAATTGCTTGAAGAAT
CACAAAACCAGCAGGAAAAGAATGAACAAGATTTACTAGCATTGGACAGA
TGGAACAGTCTGTGGAATTGGTTTAACATAACAAATTGGCTGTGGTATAT
AAAAATATTCATAATGATAGGGAGGCTTGATAGGTTTAAGAATAATTT
TTGCTGTGCTTTCTTTAGTAAATAGAGTTAGGCAGGGATACTCACCTCTG
TCATTGCAGACCCTTATCCCAAGCCCGAGGGGACCAGACAGACCCGGAGG
AATCGAAGAAGAAGGTGGAGAGCAAGACAGAAACAGATCAACGCGATTAG
TGAGCGGATTCTTAGCGCTTGCCTGGGACGACCTGCGGAGCCTGTGCCTT
TTCATCTACCACCGATTGAGAGACTTCATATTAATTGCAGCGAGAGCGGG
GGAACTTCTGGGACGCAGCAGTCTCAAGGGACTACGAGAGGATGGGAAG
CCCTTAAGTATCTGGGAAGTCTTGTGCAGTATTGGGGCCTGGAACTAAAA
AGAAGTGCTATTAGTCTATTGGATACCCTAGCAATAGCAGTAGGTGAAGG
AACAGATAGGATTCTAGAATTTGTATTAGGAATTTGTAGAGCTATCCGCA
ACATACCTACAAGAATAAGACAGGGCTTTGAAACAGCTTTGCTATAA >w053.6
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTTTATTTTGT
GCATCAGATGCTAAAGCATATGAGAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAATGACATGGTGGATCAGATG
CATGAAGATGTAATTAGTTTATGGGATCAAAGCCTCAAGCCATGTGTAAA
GTTAACCCCACTCTGTGTCACTCTAAACTGTACCAATGCTACTAATGCTA
CTGCCAGCAATAGCAGTATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGATGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACTCATGGAATTAAGCCAGTGGTTTCAACTCAACTATTG
TTAAATGGTAGCCTAGCAGAAGGAGAGATAATAATTAGATCTGAAAATAT
AACAGACAATGGCAAAACAATAATAGTACATCTCAATGAATCTGTAAAGA Fig. 15 (cont.)
TTGAGTGTACGAGACCCAGTAATAACACAAGAACAAGTATAAGAATAGGA
CCAGGACAAGCATTTTATGCAACAGGACAAGTAATAGGAGACATAAGAGA
AGCACATTGTAACATTAGTGAAAGTAAATGGAATGAAACTTTACAAAGGG
TAAGTAAAAAATTAAAAGAATACTTCCCTCATAAGAATATAACATTTCAA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTAATAGTACAGAAACTAACAGTACACGAACCATCACAATCCGCTGC
AGAATAAAACAAATTATAAACATGTGGCAGGAGGTGGGACGAGCAATGTA
TGCCCCTCCCATTGCAGGAAACATAACATGTATATCAAATATCACAGGAC
TACTATTGACAAGGGATGGAGGAGAAAACAATACGGAGACATTCGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGCGGTGGAGAGAGAAAAAAGAGCAGTGGGAATGGGAGCT
GTGTTCCTTGGGTTCTTAGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGCCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAAAATTTGTATTAGGAATTTGTAGAGCTATCCGCAACATAC
CTACAAGAATAAGACAGGGCTTTGAAACAGCTTTGCTATAA >w053.25
ATGAGAGTGATGGGGATACAGAGGAATTATCCACAATGGTGGATATGGAG
CATGTTAGGCTTGTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGGAAAATGACATGGTAGATCAGATG
CATGAAGATGTAATTAGTTTATGGGATCAAAGCCTCAAGCCATGTGTAAA
GTTGACCCCACTCTGTGTCACTCTAAACTGTACCGATGCTACTGCCAGCA
ATGCTACTGCCAGCAATGCTACTGCCAGCAATAGCAGTATAATAGAGGGA
ATGAAAAATTGCTCTTTCAATATAACCACAGAATTAAGAGATAAGAGAGA
GAAAAAGAATGCACTTTTTTATAAACTTGATATAGTACAACTAGATGGCA
ACTCTAGTCAGTATAGATTAATAAATTGTAATACCTCAGTCATAACACAA
GCCTGTCCAAAGGTCTCTTTTGACCCAATTCCTATACATTATTGTGCTCC
AGCTGGTTATGCGATTCTAAAGTGTAATAACAAGACATTCAATGGAACAG
GACCGTGTAATAATGTCAGCACAGTACAATGTACACATGGAATTAAGCCA
GTGGTTTCAACTCAACTATTGTTAAATGGTAGCCTAGCAGAAGGAGAGAT
AATAATTAGATCTGAAAATATAACAGACAATGGCAAAACAATAATAGTAC
ATCTCAATGAATCTGTAAAGATTGAGTGTACGAGACCCAGTAATAACACA
AGAACAAGTATAAGAATAGGACCAGGACAAGCATTTTATGCAACAGGACA
AGTAATAGGAGACATAAGAGAAGCACATTGTAACATTAGTGAAAATAAAT
GGAATGAAACTTTACAAAGGGTAAGTAAAAAATTAAAAGAATACTTCCCT
CATAAGAATATAACATTTCAACCATCCTCAGGAGGGGACCTAGAAATTAC Fig. 15 (cont.)
AACACATAGCTTTAATTGTGGAGGAGAATTTTTCTATTGCAATACATCAA
GCCTGTTTAATAGGACATATATGGCTAATAGTACAGATATGGCTAATAGT
ACAGAAACTAACAGTACACGAACCATCACAATCCGCTGCAGAATAAAACA
AATTATAAACATGTGGCAGGAGGTGGGACGAGCAATGTATGCCCCTCCCA
TTGCAGGAAACATAACATGTATATCAAATATCACAGGACTACTATTGACA
AGGGATGGAGGAAAAAACAATACGGAGACATTCGAGACATTCAGACCTGG
AGGAGGAAATATGAAGGACAATTGGAGAAGTGAATTATATAAATATAAAG
TGGTAGAAGTTAAGCCATTAGGAGTAGCACCCACTAATGCAAGAAGGAGA
GTGGTGGAGAGAGAAAAAAGAGCAGTGGGAATGGGAGCTGTGTTCCTTGG
GTTCTTGGGAGCGGCAGGAAGCACTATGGGCGCAGCATCAATAACGCTGA
CGGTACAGGCCAGACAATTATTGTCTGGTATAGTGCAACAGCAAAGCAAT
TTGCTGAAGGCTATAGAGGCTCAACAGCATATGTTGAAACTCACGGTCTG
GGGCATTAAACAGCTCCAGGCAAGAGTCCTGGCCTTGGAAAGATACCTAA
AGGATCAACAGCTCCTAGGGATGTGGGGCTGCTCTGGAAAACTCATCTGC
ACCACTAATGTATATTGGAACTCTAGTTGGAGTAATAAAACTTATGGTGA
TATTTGGGATAACATGACCTGGATGCAGTGGGAGAGAGAAATTAGCAATT
ATACAGAAATAATATATGAATTGCTTGAAGAATCACAAAACCAGCAGGAA
AAGAATGAACAAGATTTACTAGCATTGGACAGATGGAACAGTCTGTGGAA
TTGGTTTAACATAACAAATTGGCTGTGGTATATAAAAATATTCATAATGA
TAGTAGGAGGCTTGATAGGTTTAAGAATAATTTTTGCTGTGCTCTCTTTA
GTAAATAGAGTTAGGCAGGGATACTCACCTCTGTCATTGCAGACCCTTAT
CCCAAGCCCGAGGGGACCAGACAGGCCCGGAGGAATCGAAGAAGAAGGTG
GAGAGCAAGACAGAAAGAGATCAACGCGATTAGTGAGCGGATTCTTAGCG
CTTGTCTGGGACGACCTGCGGAGCCTGTGCCTTTTCATCTACCACCGATT
GAGAGACTTCATATTAATTGCAGCGAGAGCGGGGGAACTTCTGGGACGCA
GCAGTCTCAAGGGACTACGGAGAGGATGGGAAGCCCTTAAGTATCTGGGA
AGTCTTGTGCAGTATTGGGGCCTGGAACTAAAAAGGAGTGCTATTAGTCT
ATTGGATACCCTAGCAATAGCAGTAGGTGAAGGAACAGATAGGATTCTAG
AATTTGCATTAGGAATTTGTAGAGCTATCCGCAACATACCTACAAGAATA
AGACAGGGCTTTGAAACAGCTTTGCTATAA >w053.31
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTAGATCAGATG
CATGAAGATGTAATTAGTTTATGGGATCAAAGCCTCAAGCCATGTGTAAA
GTTGACCCCACTCTGTGTCACTCTAAACTGTACCGATGCTACTGCCAGCA
ATGCTACTGCCAGCAATGCTACTGCCAGCAATAGCAGTATAATAGAGGGA
ATGAAAAATTGCTCTTTCAATATAACCACAGAATTAAGAGATAAGAGAGA
GAAAAGAATGCACTTTTTTATAAACTTGATATAGTACAACTAGATGGCA
ACTCTAGTCAGTATAGATTAATAAATTGTAATACCTCAGTCATAACACAA
GCCTGTCCAAAGGTCTCTTTTGACCCAATTCCTATACATTATTGTGCTCC
AGCTGGTTATGCGATTCTAAAGTGTAATAATAAGACATTCAATGGAACAG
GACCGTGTAATAATGTCAGCACAGTACAATGTACACATGGAATTAAGCCA
GTGGTTTCAACTCAACTATTGTTAAATGGTAGCCTAGCAGAAGGAGAGAT
AATAATTAGATCTGAAAATTAACAGACAATGGCAAAAACAATAATAGTAC
ATCTCAATGAATCTGTAAAGATTGAGTGTACGAACCCAGTAATAACACA
AGAACAAGTATAAGAATAGGACCAGGACAAGCATTTTATGCAACAGGACA
AGTAATAGGAGACATAAGAGAAGCACATTGTAACATTAGTGAAAGTAAAT
GGAATGAAACTTTACAAAGGGTAAGTAAAAAATTAAAAGAATACTTCCCT
CATAAGAATATAACATTTCAACCATCCTCAGGAGGGGACCTAGAAATTAC
AACACATAGTTTTAATTGTGGAGGAGAATTTTTCTATTGCAATACATCAA
GCCTGTTTAATAGGACATATATGGCTAATAGTACAGAAACTAACAGTACA
CGAATCATCACAATCCGCTGCAGAATAAAACAAATTATAAACATGTGGCA
GGAGGTGGGAAGAGCAATGTATGCCCCTCCCATTGCAGGAAACATAACAT

Fig. 15 (cont.)
GTATATCAAATATCACAGGACTACTATTGACAAGGGATGGAGGAAATAAC
AATACGGAGACATTCAGACCTGGAGGAGGAAATATGAAGGACAATTGGAG
AAGTGAATTATATAAATATAAAGTGGTAGAAGTTAAGCCATTAGGAGTAG
CACCCACTAATGCAAGAAGGAGAGTGGTGGAGAGAGAAAAAAGAGCAGTG
GGAATGGGAGCTGTGTTCCTTGGGTTCTTGGGAGCGGCAGGAAGCACTAT
GGGCGCAGCATCAATAACGCTGACGGTACAGGCCAGACAATTATTGTCTG
GTATAGTGCAACAGCAAAGCAATTTGCTGAAGGCTATAGGGGCTCAACAG
CATATGTTGAAACTCACGGTCTGGGGCATTAAACAGCTCCAGGCAAGAGT
CCTGGCCTTGGAAAGATACCTAAAGGATCAACAGCTCCTAGGGATGTGGG
GCTGCTCTGGAAAACTCATCTGCACCACTAATGTATATTGGAACTCTAGT
TGGAGTAATAAAACTTATGGTGATATTTGGGATAACATGACCTGGATGCA
GTGGGAGAGAGAAATTAGCAATTATACAGAAATGATATATGAATTGCTTG
AAGAATCACAAAACCAGCAGGAAAAGAATGAACAAGATTTACTAGCATTG
GACAGATGGAACAGTCTGTGGAATTGGTTTAACATAACAAATTGGCTGTG
GTATATAAAAATATTCATAATGATAGTAGGAGGCTTGATAGGTTTAAGAA
TAATTTTTGCTGTGCTCTCTTTAGTAAATAGAGTTAGGCAGGGATACTCA
CCTCTGTCATTGCAGACCCTTATCCCAAGCCCGAGGGGACCAGACAGGCC
CGGAGGAATCGAAGAAGAAGGTGGAGAGCAAGCAGAAAGAGATCAACGC
GATTAGTGAGCGGATTCTTAGCGCTTGTCTGGGACGACCTGCGGAGCCTG
TGCCTTTTCATCTACCACCGATTGAGAGACTTCATATTAATTGCAGCGAG
AGCGGGGGAACTTCTGGGACGCAGCAGTCTCAAGGGACTACGGAGAGGAT
GGGAAGCCCTTAAGTATCTGGGAAGTCTTGTGCAGTATTGGGGCCTGGAA
CTAAAAAGGAGTGCTATTAGTCTATTGGATACCCTAGCAATAGCAGTAGG
TGAAGGAACAGATAGGATTCTAGAATTTGCATTAGGAATTTGTAGAGCTA
TCCGCAACATACCTACAAGAATAAGACAGGGCTTTGAAACAGCTTTGCTA
TAA >w053.16
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTAATGCTACTG
CCAGCAATAGCAGTATAATAGAGGGAATGAATAGCAGTATAATAGAGGGA
ATGAAAAATTGCTCTTTCAATATAACCACAGAATTAAGAGATAAGAGAGA
GAAAAAGAATGCACTTTTTTTATAAACTTGATATAGTACAACTAGATGGCA
ACTCTAGTCAGTATAGATTAATAAATTGTAATACCTCAGTCATAACACAA
GCCTGTCCAAAGGTCTCTTTTGACCCAATTCCTATACATTATTGTGCTCC
AGCTGGTTATGCGATTCTAAAGTGTAATAATAAGACATTCAATGGAACAG
GACCGTGTAATAATGTCAGCACAGTACAATGTACACATGGAATTAAGCCA
GTGGTTTCAACTCAACTATTGTTAAATGGTAGCCTAGCAGAAGGAGAGAT
AATAATTAGATCTGAAAACATAACAGACAATGGCAAAACAATAATAGTAC
ATCTCAATGAATCTGTAAAGATTGAGTGTACGAGACCCAGTAATAACACA
AGAACAAGTATAAGAATAGGACCAGGACAAGCATTTTATGCAACAGGACA
AGTAATAGGAGACATAAGAGAAGCACATTGTAACATTAGTGAAAGTAAAT
GGAATGAAACTTTACAAAGGGTAAGTGAAAAATTAAAAGAATACTTCCCT
CATAAGAATATAACATTTCAACCATCCTCAGGAGGGGACCTAGAAATTAC
AACACATAGCTTTAATTGTGGAGGAGAATTTTTCTATTGCAATACATCAA
GCCTGTTTAATAGGACATATATGGCTACTAGTACAGATATGGCTAATAGT
ACAGAAACTAACAGTACACGAATCATCACAATCCGCTGCAGAATAAAACA
AATTATAAACATGTGGCAGGAGGTGGGACGAGCAATGTATGCCCCTCCCA
TTGCAGGAAACATAACATGTATATCAAATATCACAGGACTACTATTGACA
AGGGATGGAGGAAAAAACAATACGGAGACATTCGAGACATTCAGACCTGG
AGGAGGAAATATGAAGGACAATTGGAGAAGTGAATTATATAAATATAAAG
TGGTAGAAGTTAAGCCATTAGGAGTAGCACCCACTAATGCAAGGAGGAGA

Fig. 15 (cont.)
GTGGTGGAGAGAGAAAAAAGAGCAGTGGGAATGGGAGCTGTGTTCCTTGG
GTTCTTGGGAGCGGCAGGAAGCACTATGGGCGCAGCATCAATAACGCTGA
CGGTACAGGCCAGACAATTATTGTCTGGTATAGTGCAACAGCAAAGCAAT
TTGCTGAAGGCTATAGAGGCTCAACAGCATATGTTGAAACTCACGGTCTG
GGGCATTAAACAGCTCCAGGCAAGAGTCCTGGCCTTGGAAAGATACCTAA
AGGATCAACAGCTCCTAGGGATGTGGGGCTGCTCTGGAAAACTCATCTGC
ACCACTAATGTATATTGGAACTCTAGTTGGAGTAATAAAACTTATGGTGA
TATTTGGGATAACATGACCTGGATGCAGTGGGAGAGAGAAATTAGCAATT
ATACAGAAATAATATATGAACTGCTTGAAGAATCACAAAACCAGCAGGAA
AAGAATGAACAAGATTTACTAGCATTGGACAGATGGAACAGTCTGTGGAA
TTGGTTTAACATAACAAATTGGCTGTGGTATATAAAAATATTCATAATGA
TAGTAGGAGGCTTGATAGGTTTAAGAATAATTTTTGCTGTGCTTTCTTTA
GTAAATAGAGTTAGGCAGGGATACTCACCTCTGTCGTTACAGACCCTTAT
CCCAAGCCCGAGGGGACCAGACAGGCCCGGAGGAATCGAAGAAGAAGGTG
GAGAGCAAGACAGAAACAGATCAACGCGATTAGTGAGCGGATTCTTAGCG
CTTGCCTGGGACGACCTGCGGAGCCTGTGCCTTTTCATCTACCACCGATT
GAGAGACTTCATATTAATTGCAGCGAGAGCGGGGGAACTTCTGGGACGCA
GCAGTCTCAAGGGACTACGAGAGGGTGGGAAGCCCTTAAGTATCTGGGA
AGTCTTGTGCAGTATTGGGGCCTGGAACTAAAAAGGAGTGCTATTAGTCT
ATTGGATACCCTAGCAATAGCAGTAGGTGAAGGAACAGATAGGATTCTAG
AATTTGTATTAGGAATTTGTAGAGCTATCCGCAACATACCTACAAGAATA
AGACAGGGCTTTGAAACAGCTTTGCTATAA >w053.13
ATGAGAGTGATGGGGAGACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCGATGCTACTGCCAGCA
ATGCTACTGCCAGCAATAGCAGTATAATAGAGGGAATGAATAGTAGTATA
ATAGAGGGAATGAAAAATTGCTCTTTCAATATAACCACAGAATTAAGAGA
TAAGAGAGAGAAAAAGAATGCACTTTTTTATAAACTTGATATAGTACAAC
TAGATGGCAACTCTAGTCAGTATAGATTAATAAATTGTAATACCTCAGTC
ATAACACAAGCCTGTCCAAAGGTCTCTTTTGACCCAATTCCTATACATTA
TTGTGCTCCAGCTGGTTATGCGATTCTAAAGTGTAATAATAAGACATTCA
ATGGAACAGGACCGTGTAATAATGTCAGCACAGTACAATGTACACATGGA
ATTAAGCCAGTGGTTTCAACTCAACTATTGTTAAATGGTAGCCTAGCAGA
AGGAGAGATAATAATTAGATCTGAAAACATAACAGACAATGGCAAAACAA
TAATAGTACATCTCAATGAATCTGTAAAGATTGAGTGTACGAGACCCAGT
AATAACACAAGAACAAGTATAAGAATAGGACCAGGACAAGCATTTTATGC
AACAGGACAAGTAATAGGAGACATAAGAGAAGCACATTGTAACATTAGTG
AAAGTAAATGGAATGAAACTTTACAAAGGGTAAGTGAAAAATTAAAAGAA
TACTTCCCTCATAAGAATATAACATTTCAACCATCCTCAGGAGGGGACCT
AGAAATTACAACACATAGCTTTAATTGTGGAGGAGAATTTTTCTATTGCA
ATACATCAAGCCTGTTTAACAGGACATATATGGCTACTAGTACAGATATG
GCTAATAGTACAGAAACTAACAGTACACGAATCATCACAATCCGCTGCAG
AATAAAACAAATTATAAACATGTGGCAGGAGGTGGGACGAGCAATGTATG
CCCCTCCCATTGCAGGAAACATAACATGTATATCAAATATCACAGGACTA
CTATTGACAAGGGATGGAGGAAAAAACAATACGGAGACATTCGAGACATT
CAGACCTGGAGGAGGAAATATGAAGGACAATTGGAGAAGTGAATTATATA
AATATAAAGTGGTAGAAGTTAAGCCATTAGGAGTAGCACCCACTAATGCA
AGAAGGAGAGTGGTGGAGAGAGAAAAAAGAGCAGTGGGAATGGGAGCTGT
GTTCCTTGGGTTCTTGGGAGCGGCAGGAAGCACTATGGGCGCAGCATCAA
TAACGCTGACGGTACAGGCCAGACAATTATTGTCTGGTATAGTGCAACAG
CAAAGCAATTTGCTGAAGGCTATAGAGGCTCAACAGCATATGTTGAAACT Fig. 15 (cont.)
CACGGTCTGGGGCATTAAACAGCTCCAGGCAAGAGTCCTGGCCTTGGAAA
GATACCTAAAGGATCAACAGCTCCTAGGGATGTGGGGCTGCTCTGGAAAA
CTCATCTGCACCACTAATGTATATTGGAACTCTAGTTGGAGTAATAAAAC
TTATGGTGATATTTGGGATAACATGACCTGGATGCAGTGGGAGAGAGAAA
TTAGCGATTATACAGAAATAATATATGAATTGCTTGAAGAATCACAAAAC
CAGCAGGAAAAGAATGAACAAGATTTACTAGCATTGGACAGATGGAACAG
TCTGTGGAATTGGTTTAACATAACAAATTGGCTGTGGTATATAAAAATAT
TCATAATGATAGTAGGAGGCTTGATAGGTTTAAGAATAATTTTTGCTGTG
CTTTCTTTAGTAAATAGAGTTAGGCAGGGATACTCACCTCTGTCGTTACA
GACCCTTATCCCAAGCCCGAGGGGACCAGACAGGCCCGGAGGAATCGAAG
AAGAAGGTGGAGAGCAAGACAGAAACAGATCAACGCGATTAGTGAGCGGA
TTCTTAGCGCTTGCCTGGGACGACCTGCGGAGCCTGTGCCTTTTCATCTA
CCACCGATTGAGAGACTTCATATTAATTGCAGCGAGAGCGGGGGAACTTC
TGGGACGCAGCAGTCTCAAGGGACTACGGAGAGGATGGGAAGCCCTTAAG
TATCTGGGAAGTCTTGTGCAGTATTGGGGCCTGGAACTAAAAAGGAGTGC
TATTAGTCTATTGGATACCCTAGCAATAGCAGTAGGTGAAGGAACAGATA
GGATTCTAGAATTTGTATTAGGAATTTGTAGAGCTATCCGCAACATACCT
ACAAGAATAAGACAGGGCTTTGAAACAGCTTTGCTATAA >w078.6
ATGAGAGTGATGGGGATACAGAGGAATTATCCACAATGGTGGATATGGAG
CATGTTAGGCTTGTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGCGGATCAGATG
CATGAAGATGTAATTAGTTTATGGGATCAAAGCCTCAAGCCATGTGTAAA
GTTGACCCCACTCTGTGTCACTCTAAACTGTACCGATGCTACTGCCAGCA
ATGCTACTGCCAGCAATGCTACTGCCAGCAATAGCAGTATCAATAGCAGT
ATAATAGAGGAAATGAAAAATTGCTCTTTTAATATAACCACAGAATTAAG
AGATAAGAGAGAGAAAAAGAATGCACTTTTTTATAAACTTGATATAGTAC
AACTAGATGGCAACTCTAGTCAGTATAGATTAATAAATTGTAATACCTCA
GCCATAACACAAGCCTGTCCAAAGGTATCTTTTGACCCAATTCCTATACA
TTATTGTGCTCCAGCTGGTTATGCGATTCTAAAGTGTAATAATAAGACAT
TCAATGGAACAGGACCGTGTAATAATGTCAGCACAGTACAATGTACACAT
GGAATTAAGCCAGTGGTTTCAACTCAACTATTGTTAAATGGTAGCCTAGC
AGAAGGAGAGATAATAATTAGATCTGAAAATATAACAGACAATGGCAAAA
CAATAATAGTACATCTCAATGAATCTGTAAAGATTGAGTGTACGAGACCC
AGTAATAACACAAGAACATATAAGAATAGGACCAGGACAAGCATTTTA
TGCAACAGGACAAGTAATAGGAGACATAAGAGAAGCACATTGTAACATTA
GTGAAAGTAAATGGAATGAAACTTTACAAAGGGTAAGTAAAAAATTAAAA
GAATACTTCCCTCATAAGAATATAACATTTCAACCATCCTCAGGAGGGGA
CCTAGAAGTTACAACACATAGCTTTAATTGTGGAGGAGAATTTTTCTATT
GCAATACATCAAGCCTGTTTAATAGGACAGATATGGCTAATAGTACAGAA
ACTAACAGTACACGAATCATCACAATCCGCTGCAGAATAAAACAAATTGT
AAACATGTGGCAGGAGGTGGGACGAGCAATGTATGCCCCTCCCATTGCAG
GAAACATAACATGTATATCAAATATCACAGGACTACTATTGACAAGGGAT
GGAGGAGAAAACAATGGGAGGAAAAAACAATACAGAGACATTCAGACCTGG
AGGAGGAAATATGAAGGACAATTGGAGAAGTGAATTATATAAATATAAAG
TGGTAGAAGTTAAGCCATTAGGAGTAGCACCCACTAATGCAAGAAGGAGA
GTGGTGGAGAGAGAAAAAAGAGCAGTGGGAATGGGAGCTGTGTTCCTTGG
GTTCTTGGGAGCGGCAGGAAGCACTATGGGCGCAGCATCAATAACGCTGA
CGGTACAGGCCAGACAATTATTGTCTGGTATAGTGCAACAGCAAAGCAAT
TTGCTGAAGGCTATAGAGGCTCAACAGCATATGTTGAAACTCACGGTCTG
GGGCATTAAACAGCTCCAGGCAAGAGTCCTGGCCTTGGAAAGATACCTAA
AGGATCAACAGCTCCTAGGGATGTGGGGCTGCTCTGGAAAACTCATCTGT
ACCACTAATGTATATTGGAACTCTAGTTGGAGTAATAAAACTTATGGTGA
TATTTGGGATAACATGACCTGGATGCAGTGGGAGAGAGAAATTAGCAATT Fig. 15 (cont.)
ATACAGAAATAATATATGAATTGCTTGAAGAATCACAAAACCAGCAGGAA
AAGAATGAACAAGATTTACTAGCATTGGACAGATGGAACAGTCTGTGGAA
TTGGTTTAACATAACAAAATGGCTGTGGTATATAAAAATATTCATAATGA
TAGTAGGAGGCTTGATAGGTTTAAGAATAATTTTTGCTGTGCTCTCTTTA
GTAAATAGAGTTAGGCAGGGATACTCACCTCTGTCATTGCAGACCCTTAT
CCCAAGCCCGAGGGGACCAGACAGGCCCGGAGGAATCGAAGAAGAAGGTG
GAGAGCAAGACAGAAACAGATCAACGCGATTAGTGAGCGGATTCTTAGCG
CTTGCCTGGGACGACCTGCGGAGCCTGTGCCTTTTCATCTACCACCGATT
GAGAGACTTCATATTAATTGCAGCGAGAGCGGGGGAACTTCTGGGACGCA
GCAGTCTCAAGGGACTACGGAGAGGATGGGAAGCCCTTAAGTATCTGGGA
GGTCTTGTGCAGTATTGGGGCCTGGAACTAAAAGGAGTGCTATTAGTCT
ATTGGATACCCTAGCAATAGCAGTAGGTGAAGGAACAGATAGGATTCTAG
AATTTGTATTAGGAATTTGTAGAGCTATCCGCAACATACCTACAAGAATA
AGACAGGGCTTTGAAACAGCTTTGCTATAA >w078.25
ATGAGAGTGATGGGGAGACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCACGCCATGTGTAAA
GTTGACCCCACTCTGTGTCACTCTAAACTGTACCGATGCTACTGCCAGCA
ATGCTACTGCCAGCAATGCTACTGCCAGCAATGCTACTGCCAGCAATAGC
AGTATAATAATAGAGGGAATGAAAAATTGCTCTTTCAATATAACCACAGA
ATTAAGAGATAAGAGAGAGAAAAGAATGCACTTTTTTATAAACTTGATA
TAGTACAACTAGATGGCAACTCTAGTCAGTATAGATTAATAAATTGTAAT
ACCTCAGTCATAACACAAGCCTGTCCAAAGGTCTCTTTTGACCCAATTCC
TATACATTATTGTGCTCCAGCTGGTTATGCGATTCTAAAGTGTAATAATA
AGACATTCAATGGAACAGGACCGTGTAATAATGTCAGCACAGTACAATGT
ACACATGGAATTAAGCCAGTGGTTTCAACTCAACTATTGTTAAATGGTAG
CCTAGCAGAAGGAGAGATAATAATTAGATCTAAAAATATAACAGACAATG
GCAAAACAATAATAGTACATCTCAATGAATCTGTAAAGATTGAGTGTACG
AGACCCAGTAATAACACAAGAACAAGTATAAGAATAGGACCAGGACAAGC
ATTTTATGCAACAGGACAAGTAATAGGAGACATAAGAGAAGCACATTGTA
ACATTAGTGAAAGTAAATGGAATGAAACTTTACAAAGGGTAAGTGAAAAA
TTAAAAGAATACTTCCCTAATAAGAATATAACATTTCAACCATCCTCAGG
AGGGGACCTAGAAATTACAACACATAGCTTTAATTGTGGAGGAGAATTTT
TCTATTGCAATACATCAAGCCTGTTTAATAGGACATATATGGCTAATAGT
ACAGATATGGCTAATAGTACAGAAACTAACAGTACACGAATCATCACAAT
CCGCTGCAGAATAAAACAAATTATAAACATGTGGCAGGAGGTGGGACGAG
CAATGTATGCCCCTCCCATTGCAGGAAACATAACATGTATATCAAATATC
ACAGGACTACTATTGACAAGGGATGGAGGAAAAAACAATACGGAGACATT
CGAGACATTCAGACCTGGAGGAGGAAATATGAAGGACAATTGGAGAAGTG
AATTATATAAATATAAAGTGGTAGAAGTTAAGCCATTAGGAGTAGCACCC
ACTAATGCAAGAAGGAGAGTGGTGGAGAGAGAAAAAAGAGCAGTGGGAAT
GGGAGCTGTGTTCCTTGGGTTCTTGGGAGCGGCAGGAAGCACTATGGGCG
CAGCATCAATAACGCTGACGGTACAGGCCAGACAATTATTGTCTGGTATA
GTGCAACAGCAAAGCAATTTGCTGAAGGCTATAGAGGCTCAACAGCATAT
GTTGAAACTCACGGTCTGGGGCATTAAACAGCTCCAGGCAAGAGTCCTGG
CCTTGGAAAGATACCTAAAGGATCAACAGCTCCTAGGGATGTGGGGCTGC
TCTGGAAAACTCATCTGCACCACTAATGTATATTGGAACTCTAGTTGGAG
TAATAAAACTTATGGTGATATTTGGGATAACATGACCTGGATGCAGTGGG
AGAGAGAAATTAGCAATTATACAGAAATGATATATGAATTGCTTGAAGAA
TCACAAAACCAGCAGGAAAAGAATGAACAAGATTTACTAGCATTGGACAG
ATGGAACAGTCTGTGGAATTGGTTTAACATAACAAAGTGGCTGTGGTATA
TAAAAATATTCATAATGATAGTAGGAGGCTTGATAGGTTTAAGAATAATT Fig. 15 (cont.)
TTTGCTGTGCTTTCTTTAGTAAATAGAGTTAGGCAGGGATACTCACCTCT
GTCGTTGCAGACCCTTATCCCAAGCCCGAGGGGACCAGACAGGCCCGGAG
GAATCGAAGAAGAAGGTGGAGAGCAAGACAGAAAGAGATCAACGCGATTA
GTGAGCGGATTCTTAGCGCTTGCCTGGGACGACCTGCGGAGCCTGTGCCT
TTTCATCTACCACCGATTGAGAGACTTCATATTAATTGCAGCGAGAGCGG
GGGAACTTCTGGGACGCAGCAGTCTCAAGGGACTACGGAGAGGATGGGAA
GCCCTTAAGTATCTGGGAAGTCTTGTGCAGTATTGGGCCGGGAACTAAA
AAGGAGTGCTATTAGTCTATTGGATACCCTAGCAATAGCAGTAGGTGAAG
GAACAGATAGGATTCTAGAATTTGCATTAAGAATTTGTAGAGCTATCCGC
AACATGCCTACAAGAATAAGACAGGGCTTTGAAACAGCTTTGCTATAA >w078.9
ATGAGAGTGATGGGGATACAGAGGAATTATCCACAATGGTGGATATGGAG
CATGTTAGGCTTGTGGATGCTAATGATTTGTAATGGGATGTGGGTCACAG
TCTACTATGGGGTACCTGTGTGGAAAGAAGCAAAACTACTCTATTTTGT
GCATCAGATGCTAAAGCATATGAGAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTAGATCAGATG
CATGAAGATGTAATTAGTTTATGGGATCAAAGCCTCAAGCCATGTGTAAA
GTTGACCCCACTCTGTGTCACTCTAAACTGTACCGATGCTACTGCCAGCA
ATGCTACTGCCAGCAATGCTACTGCCAGCAATGCTACTGCCAGCAATAGC
AGTATAATAATAGAGGGAATGAAAAATTGCTCTTTCAATATAACCACAGA
ATTAAGAGATAAGAGAGAGAAAAAGAATGCACTTTTTTATAAACTTGATA
TAGTACAACTAGATGGCAACTCTAGTCAGTATAGATTAATAAATTGTAAT
ACCTCAGTCATAACACAAGCCTGTCCAAAGGTCTCTTTTGACCCAATTCC
TATACATTATTGTGCTCCAGCTGGTTATGCGATTCTAAAGTGTAATAATA
AGACATTCAATGGAACAGGACCGTGTAATAATGTCAGCACAGTACAATGT
ACACATGGAATTAAGCCAGTGGTTTCAACTCAACTATTGTTAAATGGTAG
CCTAGCAGAAGGAGAGATAATAATTAGATCTAAAAATATAACAGACAATG
GCAAAACAATAATAGTACATCTCAATGAATCTGTAAAGATTGAGTGTACG
AGACCCAGTAATAACACAAGAACAAGTATAAGAATAGGACCAGGACAAGC
ATTTTATGCAACAGGACAAGTAATAGGAGACATAAGAGAAGCACATTGTA
ACATTAGTGAAAGTAAATGGAATGAAACTTTACAAAGGGTAAGTAAAAAA
TTAAAAGAATACTTCCCTCAGAAGAATATAACATTTCAACCATCCTCAGG
AGGGGACCTAGAAATTACAACACATAGCTTTAATTGTGGAGGAGAATTTT
TCTATTGCAATACATCAAGCCTGTTTAATAGGACATATATGGCTAATAGT
ACAGATATGGCTAATAGTACAGAAACTAACAGAACCATCACAATCCGCTG
CAGAATAAAACAAATTATAAACATGTGGCAGGAAGTGGGACGAGCAATGT
ATGCCCCTCCCATTGCAGGAAACATAACATGTATATCAAATATCACAGGA
CTACTATTGACAAGGGATGGAGGAAAAAACAATACGGAGACATTCGAGAC
ATTCAGACCTGGAGGAGGAAATATGAAGGACAATTGGAGAAGTGAATTAT
ATAAATATAAAGTGGTAGAAGTTAAGCCATTAGGAGTAGCACCCACTAAT
GCAAGAAGGAGAGTGGTGGAGAGAGAAAAAAGAGCAGTGGGAATGGGAGC
TGTGTTCCTTGGGTTCTTGGGAGCGGCAGGAAGCACTATGGGCGCAGCAT
CAATAACGCTGACGGTACAGGCCAGACAATTATTGTCTGGTATAGTGCAA
CAGCAAAGCAATTTGCTGAAGGCTATAGAGGCTCAACAGCATATGTTGAA
ACTCACGGTCTGGGGCATTAAACAGCTCCAGGCAAGAGTCCTGGCCTTGG
AAAGATACCTAAAGGATCAACAGCTCCTAGGGATGTGGGCTGCTCTGGA
AAACTCATCTGCACCACTAATGTATATTGGAACTCTAGTTGGAGTAATAA
AACTTATGGTGATATTTGGGATAACATGACCTGGATGCAGTGGGAGAGAG
AAATTAGCAATTATACAGAAATGATATATGAATTGCTTGAAGAATCACAA
AACCAGCAGGAAAGAATGAACAAGATTTACTAGCATTGGACAGATGGAA
CAGTCTGTGGAATTGGTTTAACATAACAAAGTGGCTGTGGTATATAAAAA
TATTCATAATGATAGTAGGAGGCTTGATATGTTTAAGAATAATTTTTGCT
GTGCTTTCTTTAGTAAATAGAGTTAGGCAGGGATACTCACCTCTGTCGTT
GCAGACCCTTATCCCAAGCCCGAGGGGACCAGACAGGCCCGGAGGAATCG
AAGAAGAAGGTGGAGAGCAAGACAGAAAGAGATCAACGCGATTAGTGAGC
GGATTCTTAGCGCTTGTCTGGGACGACCTGCGGAGCCTGTGCCTTTTCAT Fig. 15 (cont.)
CTACCACCGATTGAGAGACTTCATATTAATTGCAGCGAGAGCGGGGGAAC
TTCTGGGACGCAGCAGTCTCAAGGGACTACGGAGAGGATGGGAAGCCCTT
AAGTATCTGGGAAGTCTTGTGCAGTATTGGGGCCTGGAACTAAAAAGGAG
TGCTATTAGTCTATTGGATACCCTAGCAATAGCAGTAGGTGAAGGAACAG
ATAGGATTCTAGAATTTGCATTAGGAATTTGTAGAGCTATCCGCAACATA
CCTACAAGAATAAGACAGGGCTTTGAAACAGCTTTGCTATAA >w078.33
ATGAGAGTGACGGGGATACAGAGGAATTATCCACAATGGTGGATATGGAG
CATGTTAGGCTTGTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAATGACATGGCAGATCAGATG
CATGAAGATGTAATTAGTTTATGGGATCAAAGCCTCAAGCCATGTGTAAA
GTTGACCCCACTCTGTGTCACTCTAAACTGTATCGATGCCAATGCTACTG
CCAGCAATGCTACTGCCAGCAATAGCAGTATAATAGGGAATGAAAAAT
TGCTCTTTCAATATAACCACAGAATTAAGAGATAAGATAGAGAAAAGAA
TGCACTTTTTTATAAACTTGATATAGTACAACTAGATGGCAACTCTAGTC
AGTATAGATTAATAAATTGTAATACCTCAGTCATAACACAAGCCTGTCCA
AAGGTCTCTTTTGACCCAATTCCTATACATTATTGTGCTCCAGCTGGTTA
TGCGATTCTAAAGTGTAATAATAAGACCATTCAATGGAACGGACCGTGTA
ATAATGTCAGCACAGTACAATGTACACATGGAATTAAGCCAGTGGTTTCA
ACTCAACTATTGTTAAATGGTAGCCTAGCAGAAGGAGAGATAATAATTAG
ATCTGAAAATATAACAAACAGTGCCAAAACAATAATAGTACATCTCAATG
AATCTGTAAAGATTGAGTGTACGAGACCCAGTAATAACACAAGAACAAGT
ATAAGAATAGGACCAGGACAAGCATTTTATGCAACAGGACAAGTAATAGG
AGACATAAGAAAAGCACATTGTAACATTAGTGAAAGTAAATGGAATGAAA
CTTTACAAAGGGTAAGTAAAAAATTAAAAGAATACTTCCCTCATAAGAAT
ATAACATTTCAACCATCCTCAGGAGGGGACCTAGAAATTACAACACATAG
CTTTAATTGTGGAGGAGAATTTTTCTATTGCAATACATCAAGCCTGTTTA
ATAGGACATACATGGCTAATAGTACAGAAACTAACAGTACACGAACCATC
ACACTCCACTGCAGAATAAAACAAATTATAAACATGTGGCAGGAGGTGGG
ACGAGCAATGTATGCCCCTCCCATTGCAGGAAACATAACATGTATATCAA
ATATCACAGGACTACTATTGACAAGGGATGGAGGAAATAACAATACTACG
GAGACATTCAGACCTGGAGGAGGAAATATGAAGGACAATTGGAGAAGTGA
ATTATATAAATATAAAGTGGTAGAAATTAAGCCATTAGGAGTAGCACCCA
CTAATGCAAGAAGGAGAGTGGTGGAGAGAGAAAAAAGAGCAGTGGGAATG
GGAGCTGTGTTCCTTGGGTTCTTGGGAGCGGCAGGAAGCACTATGGGCGC
AGCATCAATAACGCTGACGGTACAGGCCAGACAATTATTGTCTGGTATAG
TGCAACAGCAAAGCAATTTGCTGAAGGCTATAGAGGCTCAACAGCATATG
TTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCT
CTGGAAAACTCATCTGCACCACTAATGTATATTGGAACTCTAGTTGGAGT
AATAAAACTTATGGTGATATTTGGGATAACATGACCTGGATGCAGTGGGA
GAGAGAAATTAGCGATTATACAGAAATAATATATGAATTGCTTGAAGAAT
CACAAAACCAGCAGGAAAAGAATGAACAAGATTTACTAGCATTGGACAGA
TGGAACAGTCTGTGGAATTGGTTTAACATAACAAACTGGCTGTGGTATAT
AAAAATATTCATAATGATTAGTAGGAGGCTTGATAGGTTTAAGAATAATTT
TTGCTGTGCTTTCTTTAGTAAATAGAGTTAGGCAGGGATACTCACCTCTG
TCGTTGCAGACCCTTACCCCAAGCCCGAGGGGACCAGACAGGCCCGGAGG
AATCGAAGAAGAAGGTGGAGAGCAAGACAGAAACAGATCAACGCGATTAG
TGAGCGGATTCTTAGCGCTTGCCTGGGACGACCTGCGGAGCCTGTGCCTT
TTCATCTACCACCGATTGAGAGACTTCATATTAATTGCAGCGAGAGCGGG
GGAACTTCTGGGACGCAGCAGTCTCAAGGGACTACGGAGAGGATGGGAAG
CCCTTAAGTATCTGGGAGGTCTTGTGCAGTATTGGGGCCTGGAACTAAAA
AGGAGTGCTATTAGTCTATTGGATACCCTAGCAATAGCAGTAGGTGAAGG
AACAGATAGGATTCTAGAATTTGTATTAGGAATTTGTAGAGCTATCCGCA

Fig. 15 (cont.)
ACATACCTACAAGAATAAGACAGGGCTTTGAAACAGCTTTGCTATAA

>w078.17
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTTAACATGTGGAAAAATGACATGGTGGATCAGATG
CATGAAGATGTAATTAGTTTATGGGATCAAAGCCTCAAGCCATGTGTAAA
GTTAACCCCACTCTGTGTCACTCTAGACTGTATCAATGCTACTAATGCTA
CTGCCAGCAATAGCAGTATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGGTGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACTCATGGAATTAAGCCAGTGGTTTCAACTCAACTATTG
TTAAATGGTAGCCTAGCAGAAGGAGAGATAATAATTAGATCTAAAAATAT
AACAGACAATGGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAATAATAGGAGACATAAGAGA
AGCACATTGTAACATTAGTGAAAGTAAATGGAATGAAACTTTACAAAGGG
TAAGTAAAAAATTAAAAGAATACTTCCCTGATAAGAATATAACATTTCAA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGTTAATAGTACAGATATGGCTAATAGTACAGAAACTAACAGTACACGA
ACCATCACAATCCGCTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAGAAAACAAT
ACGGAGACATTCGAGACATTCAGACCTGGAGGAGGAAATATGAAGGACAA
TTGGAGAAGTGAATTATATAAATATAAAGTGGTAGAAGTTAAGCCATTAG
GAGTAGCACCCACTAATGCAAGAAGGAGAGTGGTGGAGAGAGAAAAAAGA
GCAGTGGGAATGGGAGCTGTGTTCCTTGGGTTCTTGGGAGCGGCAGGAAG
CACTATGGGCGCAGCATCAATAACGCTGACGGTACAGGCCAGACAATTAT
TGTCTGGTATAGTGCAACAGCAAAGCAATTTGCTGAAGGCTATAGAGGCT
CAACAGCATATGTTGAAACTCACGGTCTGGGGCATTAAACAGCTCCAGGC
AAGAGTCCTGGCCTTGGAAAGATACCTAAAGGATCAACAGCTCCTAGGGA
TGTGGGGCTGCTCTGGAAAACTCATCTGCACCACTAATGTATATTGGAAC
TCTAGTTGGAGTAATAAAACTTATGGTGATATTTGGGATAACATGACCTG
GATGCAGTGGGAGAGAGAAATTAGCAATTATACAGAACTAATATATGAAT
TGCTTGAAGAATCACAAAACCAGCAGGAAAAGAATGAACAAGATTTACTA
GCATTGGACAGATGGAACAGTCTGTGGAATTGGTTTAACATAACAAATTG
GCTGTGGTATATAAAAATATTCATAATGATAGTAGGAGGCTTGATAGGTT
TAAGAATAATTTTTGCTGTGCTTTCTTTAGTAAATAGAGTTAGGCAGGGA
TACTCACCTCTGTCATTGCAGACCCTTATCCCAAGCCCGAGGGGACCAGA
CAGGCCCGGAGGAATCGAAGAAGAAGGTGGAGAGCAAGACAGAAACAGAT
CAACGCGATTAGTGAGCGGATTCTTAGCGCTTGCCTGGGACGACCTGCGG
AGCCTGTGCCTTTTCATCTACCACCGATTGAGAGACTTCATATTAATTGC
AGCGAGAGCGGGGAACTTCTGGGACGCAGCAGTCTCAAGGGACTACGGA
GAGGGTGGGAAGCCCTTAAGTATCTGGGAAGTCTTGTGCAGTATTGGGGC
CTGGAACTAAAAAGGAGTGCTATTAGTCTATTGGATACCCTAGCAATAGC
AGTAGGTGAAGGAACAGATAGGATTCTAGAATTTGTATTAGGAATTTGTA
GAGCTATCCGCAACATACCTACAAGAATAAGACAGGGCTTTGAAACAGCT
TTGCTATAA

>w078.1
ATGAGAGTGATGGGGATACAGAGGAATTATCCACAATGGTGGATATGGAG

Fig. 15 (cont.)
```
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAG
GTTGACCCCACTCTGTGTCACTCTAAACTGTATCAATGCTACTAATGCTA
CTGCCAGCAATAACAGTATATTAGAGGGAATGAAAAATTGCTCTTTCAAT
ATAGCCACAGAATTAAGAGATAAGAGAGAGAAAAAGAATGCACTTTTTTA
TAAACTTGATATAGTACAACTAGATGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTAAAAATAT
AACAGACAATGGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAAATATAAGAGA
AGCACATTGTAACATTAGTGAAAGTAAATGGAATGAAACTTTACAAAGGG
TAAGTAAAAAATTAAAAGAATACTTCCCTGAAAGAATATAACATTTCAA
CCATCCTCAGGAGGGGACCTAGAAATTACAACACATAGCTTTAGTTGTGG
AGGAGAATTTTTCTATTGCAATACATCAAGCCTGTTTAATAGGACATATA
TGGCTACTAATACAGATATGGCTAATAGTACAGAAACTAACAGTACACGA
ATCATCACAATCCGCTGCAGAATAAGACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAGAAAACAAT
ACGGAGACATTCGAGACATTCAGACCTGGAGGAGGAAATATGAAGGACAA
TTGGAGAAGTGAATTATATAAATATAAAGTGGTAGAAGTTAAGCCATTAG
GAGTAGCACCCACTAATGCAAGAAGGAGAGTGGTGGAGAGAGAAAAAAGA
GCAGTGGGAATGGGAGCTGTGTTCCTTGGGTTCTTGGGAGCGGCAGGAAG
CACTATGGGCGCAGCATCAATAACGCTGACGGTACAGGCCAGACAATTAT
TGTCTGGTATAGTGCAACAGCAAAGCAATTTGCTGAAGGCTATAGAGGCT
CAACAGCATATGTTGAAACTCACGGTCTGGGGCATTAAACAGCTCCAGGC
AAGAGTCCTGGCCTTGGAAAGATACCTAAAGGATCAACAGCTCCTAGGGA
TGTGGGGCTGCTCTGGAAAACTCATCTGCACCACTAATGTATATTGGAAC
TCTAGTTGGAGTAATAAAACTTATGGTGATATTTGGGATAACATGACCTG
GATGCAGTGGGAGAGAGAAATTAGCAATTATACAGAACTAATATATGAAT
TGCTTGAAGAATCACAAAACCAGCAGGAAAAGAATGAACAAGATTTACTA
GCATTGGACAGATGGAACAGTCTGTGGAATTGGTTTAACATAACAAATTG
GCTGTGGTATATAAAAATATTCATAATGATAGTAGGAGGCTTGATAGGTT
TAAGAATAATTTTTGCTGTGCTTTCTTTAGTAAATAGAGTTAGGCAGGGA
TACTCACCTCTGTCATTGCAGACCCTTATCCCAAGCCCGAGGGGACCAGA
CAGGCCCGGAGGAATCGAAGAAGAAGGTGGAGAGCAAGACAGAAACAGAT
CAACGCGATTAGTGAGCGGATTCTTAGCGCTTGCCTGGGACGACCTGCGG
AGCCTGTGCCTTTTCATCTACCACCGATTGAGAGACTTCATATTAATTGC
AGCGAGAGCGGGGGAACTTCTGGGACGCAGCAGTCTCAAGGGACTACGGA
GAGGGTGGGAAGCCCTTAAGTATCTGGGAAGTCTTGTGCAGTATTGGGGC
CTGGAACTAAAAAGGAGTGCTATTAGTCTATTGGACTACCCTAGCAATAGC
AGTAGGTGAAGGAACAGATAGGATTCTAGAATTTGTATTAGGAATTTGTA
GAGCTATCCGCAACATACCTACAAGAATAAGACAGGGCTTTGAAACAGCT
TTGCTATAA
>w078.15
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
```

Fig. 15 (cont.)
CATGAAGATGTAATTAGTTTATGGGATCAAAGCCTCAAGCCATGTGTAAA
GTTGACCCCACTCTGTGTCACTCTAAGCTGTACCAATGCTACTAATGCTA
CTGCCAGCAATAGCAGTATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGATGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTAAAAATAT
AACAGACAATGGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAGACATAAGAGA
AGCACATTGTAACATTAGTGAAAGTAAATGGAATGAAACTTTACAAAGGG
TAAGTGAAAAATTAAAAGAATACTTCCCTCATAAGAATATAACATTTCAA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTACTAGTACAGATATGGCTAATAGTACAGAAACTAACAGTACACGA
ATCATCACAATCCGCTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAAAAACGAT
ACGGATACATTCAGACCTGAAGGAGGAAATATGAAGGACAATTGGAGAAG
TGAATTATATAAATATAAAGTGGTAGAAGTTAAGCCATTAGGAGTAGCAC
CCACTAATGCAAGAAGGAGAGTGGTGGAGAGAGAAAAAAGAGCAGTGGGA
ATGGGAGCTGTGTTCCTTGGGTTCTTGGGAGCGGCAGGAAGCACTATGGG
CGCAGCATCAATAACGCTGACGGTACAGGCCAGACAATTATTGTCTGGTA
TAGTGCAACAGCAAAGCAATTTGCTGAAGGCTATAGAGGCTCAACAGCAT
ATGTTGAAACTCACGGTCTGGGGCATTAAACAGCTCCAGGCAAGAGTCCT
GGCCTTGGAAAGATACCTAAAGGATCAACAGCTCCTAGGGATGTGGGGCT
GCTCTGGAAAACTCATCTGCACCACTAATGTATATTGGAACTCTAGTTGG
AGTAATAAAACTTATGGTGATATTTGGGATAACATGACCTGGATGCAGTG
GGAGAGAGAAATTAGCAATTATACAGAACTAATATATGAATTGCTTGAAG
AATCACAAAACCAGCAGGAAAAGAATGAACAAGATTTACTAGCATTGGAC
AGATGGAACAGTCTGTGGAATTGGTTTAACATAACAAATTGGCTGTGGTA
TATAAAAATATTCATAATGATAGTAGGAGGCTTGATAGGTTTAAGAATAA
TTTTTGCTGTGCTTTCTTTAGTAAATAGAGTTAGGCAGGGATACTCACCT
CTGTCATTGCAGACCCTTATCCCAAGCCCGAGGGGACCAGACAGGCCCGG
AGGAATCGAAGAAGAAGGTGGAGAGCAAGACAAGACAGATCAACGCGAT
TAGTGAGCGGATTCTTAGCGCTTGCCTGGGACGACCTGCGGAGCCTGTGC
CTTTTCATCTACCACCGATTGAGAGACTTCATATTAATTGCAGCGAGAGC
GGGGGAACTTCTGGGACGCAGCAGTCTCAAGGGACTACGGAGAGGGTGGG
AAGCCCTTAAGTATCTGGGAAATCTTGTGCAGTATTGGGGCCTGGAACTA
AAAAGGAGTGCTATTAGTCTATTGGATACCCTAGCAATAGCAGTAGGTGA
AGGAACAGATAGGATTCTAGAATTTGTATTAGGAATTTGTAGAGCTATCC
GCAACATACCTACAAGAATAAGACAGGGCTTTGAAACAGCTTTGCTATAA
>w078.10
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTATCGATGCTACTGCCAGCA
ATGCTACTGCCATCAATATCAGTATAATAGAGGGAAATGAAAATTGCTCT
TTCAATATAACCACAGAATTAAGAGATAAGAGAGAGAAAAAGAATGCACT
TTTTTATAAACTTGATATAGTACAACTAGATGGCAACTCTAGTCAGCATA
GATTAATAAATTGTAATACCTCAGTCATAACACAAGCCTGTCCAAAGGTC

Fig. 15 (cont.)
TCTTTTGACCCAATTCCTATACATTATTGTGCTCCAGCTGGTTATGCGAT
TCTAAAGTGTAATAATAAGACATTCAATGGAACAGGACCGTGTAATAATG
TCAGCACAGTACAATGTACACATGGAATTAAGCCAGTGGTTTCAACTCAA
CTATTGTTAAATGGTAGCCTAGCAGAAGGAGAGATAATAATTAGATCTAA
AAATATAACAGACAATGGCAAAACAATAATAGTACATCTCAATGAATCTG
TAAAGATTGAGTGTACGAGACCCAGTAATAACACAAGAACAAGTATAAGA
ATAGGACCAGGACAAGCATTTTATGCAACAGGACAAGTAATAGGAAATAT
AAGAGAAGCACATTGTAACATTAGTGAAAGTAAATGGAATGAAACTTTAC
AAAGGGTAAGTGAAAAATTAAAAGAATACTTCCCTCATAAGAATATAACA
TTTCAACCATCCTCAGGAGGGGACCTAGAAATTACAACACATAGCTTTAA
TTGTGGAGGAGAATTTTTCTATTGCAATACATCAAGCCTGTTTAATAGGA
CATATATGGCTACTAGTACAGATATGGCTAATAGTACAGAAACTAACAGT
ACACGAATCATCACAATCCGCTGCAGAATAAAACAAATTATAAACATGTG
GCAGGAGGTGGGACGAGCAATGTATGCCCCTCCCATTGCAGGAAACATAA
CATGTATATCAAATATCACAGGACTACTATTGACAAGGGATGGAGGAAAA
AACGATACGGATACGGAGACATTCAGACCTGAAGGAGGAAATATGAAGGA
CAATTGGAGAAGTGAATTATATAAATATAAAGTGGTAGAAGTTAAGCCAT
TAGGAGTAGCACCCACTAATGCAAGAAGGAGAGTGGTGGAGAGAGAAAAA
AGAGCAGTGGGAATGGGAGCTGTGTTCCTTGGGTTCTTGGGAGCGGCAGG
AAGCACTATGGGCGCAGCATCAATAACGCTGACGGTACAGGCCAGACAAT
TATTGTCTGGTATAGTGCAACAGCAAAGCAATTTGCTGAAGGCTATAGAG
GCTCAACAGCATATGTTGAAACTCACGGTCTGGGCATTAAACAGCTCCA
GGCAAGAGTCCTGGCCTTGGAAAGATACCTAAAGGATCAACAGCTCCTAG
GGATGTGGGGCTGCTCTGGAAAACTCATCTGCACCACTAATGTATATTGG
AACTCTAGTTGGAGTAATAAAACTTATGGTGATATTTGGGATAACATGAC
CTGGATGCAGTGGGAGAGAGAAATTAGCAATTATACAGACATAATATATG
AATTGCTTGAAGAATCACAAAACCAGCAGGAAAAGAATGAACAAGATTTA
CTAGCATTGGACAGATGGAACAGTCTGTGGAATTGGTTTAACATAACAAA
TTGGCTGTGGTATATAAAAATATTCATAATGATAGTAGGAGGCTTGATAG
GTTTAAGAATAATTTTTGCTGTGCTTTCTTTAGTAAATAGAGTTAGGCAG
GGATACTCACCTCTGTCATTGCAGACCCTTATCCCAAGCCCGAGGGGACC
AGACAGGCCCGGAGGAATCGAAGAAGAAGGTGGAGAGCAAGCAGAAACA
GATCAACGCGATTAGTGAGCGGATTCTTAGCGCTTGTCTGGGACGACCTG
CGGAGCCTGTGCCTTTTCATCTACCACCGATTGAGAGACTTCATATTAAT
TGCAGCGAGAGCGGGGGAACTTCTGGGACGCAGCAGTCTCAAGGGACTAC
GGAGAGGGTGGGAAGCCCTTAAGTATCTGGGAAGTCTTGTGCAGTATTGG
GGCCTGGAACTAAAAAGGAGTGCTATTAGTCTATTGGATACCCTAGCAAT
AGCAGTAGGTGAAGGAACAGATAGGATTCTAGAATTTGTATTAGGAATTT
GTAGAGCTATCCGCAACATACCTACAAGAATAAGACAGGGCTTTGAAACA
GCTTTGCTATAA
>w078.38
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTATCGATGCTACTGCCAGCA
ATGCTACTGCCATCAATATCAGTATAATAGAGGAAATGAAAAATTGCTCT
TTCAATATAACCACAGAATTAAGAGATAAGAGAGAAGAAAGAGAATGCACT
TTTTTATAAACTTGATATAGTACAACTAGATGGCAACTCTAGTCAGCATA
GATTAATAAATTGTAATACCTCAGTCATAACACAAGCCTGTCCAAAGGTC
TCTTTTGACCCAATTCCTATACATTATTGTGCTCCAGCTGGTTATGCGAT
TCTAAAGTGTAATAATAAGACATTCAATGGAACAGGACCGTGTAATAATG
TCAGCACAGTACAATGTACACATGGAATTAAGCCAGTGGTTTCAACTCAA
CTATTGTTAAATGGTAGCCTAGCAGAAGGAGAGATAATAATTAGATCTAA
AAATATAACAGACAATGGCAAAACAATAATAGTACATCTCAATGAATCTG

Fig. 15 (cont.)
TAAAGATTGAGTGTACGAGACCCAGTAATAACACAAGAACAAGTATAAGA
ATAGGACCAGGACAAGCATTTTATGCAACAGGACAAGTAATAGGAAATAT
AAGAGAAGCACATTGTAACATTAGTAAAAGTAAATGGAATGAAACTTTAC
AAAGGGTAAGTGAAAAATTAAAAGAATACTTCCCTCATAAGAATATAACA
TTTCAACCATCCTCAGGAGGGGACCTAGAAATTACAACACATAGCTTTAA
TTGTGGAGGAGAATTTTTCTATTGCAATACATCAAGCCTGTTTAATAGGA
CATATATGGCTACTAGTACAGATATGGCTAATAGTACAGAAACTAACAGT
ACACGAATCATCACAATCCGCTGCAGAATAAAACAAATTATAAACATGTG
GCAGGAGGTGGGACGAGCAATGTATGCCCCTCCCATTGCAGGAAACATAA
CATGTATATCAAATATCACAGGACTACTATTGACAAGGGATGGAGGAAAA
AACGATACGGATACGGAGACATTCAGACCTGAAGGAGGAAATATGAAGGA
CAATTGGAGAAGTGAATTATATAAATATAAAGTGGTAGAAGTTAAGCCAT
TAGGAGTAGCACCCACTAATGCAAGAAGGAGAGTGGTGGAGAGAGAAAAA
AGAGCAGTGGGAATGGGAGCTGTGTTCCTTGGGTTCTTGGGAGCGGCAGG
AAGCACTATGGGCGCAGCATCAATAACGCTGACGGTACAGGCCAGACAAT
TATTGTCTGGTATAGTGCAACAGCAAAGCAATTTGCTGAAGGCTATAGAG
GCTCAACAGCATATGTTGAAACTCACGGTCTGGGGCATTAAACAGCTCCA
GGCAAGAGTCCTGGCCTTGGAAAGATACCTAAAGGATCAACAGCTCCTAG
GGATGTGGGGCTGCTCTGGAAAACTCATCTGCACCACTAATGTATATTGG
AACTCTAGTTGGAGTAATAAAACTTATGGTGATATTTGGGATAACATGAC
CTGGATGCAGTGGGAGAGAGAAATTAGCAATTATACAGACATAATATATG
AATTGCTTGAAGAATCACAAAACCAGCAGGAAAAGAATGAACAAGATTTA
CTAGCATTGGACAGATGGAACAGTCTGTGGAATTGGTTTAACATAACAAA
TTGGCTGTGGTATATAAAAATATTCATAATGATAGTAGGAGGCTTGATAG
GTTTAAGAATAATTTTTGCTGTGCTTTCTTTAGTAAATAGAGTTAGGCAG
GGATACTCACCTCTGTCATTGCAGACCCTTATCCCAAGCCCGAGGGGACC
AGACAGGCCCGGAGGAATCGAAAAGAAGGTGGAGAGCAAGACAGAAACA
GATCAACGCGATTAGTGAGCGGATTCTTAGCGCTTGTCTGGGACGACCTG
CGGAGCCTGTGCCTTTTCATCTACCACCGATTGAGAGACTTCATATTAAT
TGCAGCGAGAGCGGGGGAACTTCTGGGACGCAGCAGTCTCAAGGGACTAC
GGAGAGGGTGGGAAGCCCTTAAGTATCTGGGAAGTCTTGTGCAGTATTGG
GGCCTGGAACTAAAAAGGAGTGCTATTAGTCTATTGGATACCCTAGCAAT
AGCAGTAGGTGAAGGAACAGATAGGATTCTAGAATTTGTATTAGGAATTT
GTAGAGCTATCCGCAACATACCTACAAGAATAAGACAGGGCTTTGAAACA
GCTTTGCTATAA
>w078.7
ATGAGAGTGATGGGGATACAGAGGAATTATACACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGTTAATGCTACTG
CCAGCAATAGCAGTATAATAGAGGGAATGAATAGCAGTATATTAGAGGGA
ATGAAAAATTGCTCTTTCAATATAACCACAGAATTAAGAGATAAGAGAGA
GAAAAGAATGCACTTTTTTATAAACTTGATATAGTACAACTAGGTGGCA
ACTCTAGTCAGTAGATTAATAAATTGTAATACCTCAGTCATAACACAA
GCCTGTCCAAAGGTCTCTTTTGACCCAATTCCTATACATTATTGTGCTCC
AGCTGGTTATGCGATTCTAAAGTGTAATAATAAGACATTCAATGGAACAG
GACCGTGTAATAATGTCAGCACAGTACAATGTACACATGGAATTAAGCCA
GTGGTTTCAACTCAACTATTGTTAAATGGTAGCCTAGCAGAAGGAGAGAT
AATAATTAGATCTAAAAATATAACAGACAATGGCAAAACAATAATAGTAC
ATCTCAATGAATCTGTAAAGATTGAGTGTACGAGACCCAGTAATAACACA
AGAACAAGTATAAGAATAGGACCAGGACAAGCATTTTATGCAACAGGACA
AGTAATAGGAGACATAAGAGAAGCATTGTAACATTAGTGAAAGTAAAT
GGAATGAAACTTTACAAAGGGTAAGTGAAAAATTAAAAGAATACTTCCCT
GATAAGAATATAACATTTCAACCATCCTCAGGAGGGGACCTAGAAATTAC Fig. 15 (cont.)
AACACATAGCTTTAATTGTGGAGGAGAATTTTTCTATTGCAATACATCAA
GCCTGTTTAATAGGACATATATGGCTAATAGTACAGATATGGCTAATAGT
ACAGAAACTAACAGTACACGAATCATCACAATCCGCTGCAGAATAAAACA
AATTATAAACATGTGGCAGGAGGTGGGACGAGCAATGTATGCCCCTCCCA
TTGCAGGAAACATAACATGTATATCAAATATCACAGGACTACTATTGACA
AGGGATGGAGGAGAAAACAATACGGAGACATTCGAGACATTCAGACCTGG
AGGAGGAAATATGAAGGACAATTGGAGAAGTGAATTATATAAATATAAAG
TGGTAGAAGTTAAGCCATTAGGAGTAGCACCCACTAATGCAAGAAGGAGA
GTGGTGGAGAGAGAAAAAAGAGCAGTGGGAATGGGAGCTGTGTTCCTTGG
GTTCTTGGGAGCGGCAGGAAGCACTATGGGCGCAGCATCAATAACGCTGA
CGGTACAGGCCAGACAATTATTGTCTGGTATAGTGCAACAGCAAAGCAAT
TTGCTGAAGGCTATAGAGGCTCAACAGCATATGTTGAAACTCACGGTCTG
GGGCATTAAACAGCTCCAGGCAAGAGTCCTGGCCTTGGAAAGATACCTAA
AGGATCAACAGCTCCTAGGGATGTGGGGCTGCTCTGGAAAACTCATCTGC
ACCACTAATGTATATTGGAACTCTAGTTGGAGTAATAAAACTTATGGTGA
TATTTGGGATAACATGACCTGGATGCAGTGGGAGAGAGAAATTAGCAATT
ATACAGAACTAATATATGAATTGCTTGAAGAATCACAAAACCAGCAGGAA
AAGAATGAACAAGATTTACTAGCATTGGACAGATGGAACAGTCTGTGGGA
CTGGTTTAACATAACAAATTGGCTGTGGTATATAAAAATATTCATAATGA
TAGTAGGAGGCTTGATAGGTTTAAGAATAATTTTTGCTGTGCTTTCTTTA
GTAAATAGAGTTAGGCAGGGATACTCACCTCTGTCATTGCAGACCCTTAT
CCCAAGCCCGAGGGGACCAGACAGGCCCGGAGGAATCGAAGAAGAAGGTG
GAGAGCAAGACAGAAACAGATCAACGCGATTAGTGAGCGGATTCTTAGCG
CTTGCCTGGGACGACCTGCGGAGCCTGTGCCTTTTCATCTACCACCGATT
GAGAGACTTCATATTAATTGCAGCGAGAGCGGGGAACTTCTGGGACGCA
GCAGTCTCAAGGGACTACGGAGAGGGTGGGAAGCCCTTAAGTATCTGGGA
AGTCTTGTGCAGTATTGGGGCCTGGAACTAAAAAGGAGTGCTATTAGTCT
ATTGGATACCCTAGCAATAGCAGTAGGTGAAGGAACAGATAGGATTCTAG
AATTTGTATTAGGAATTTGTAGAGCTATCCGCAACATACCTACAAGAATA
AGACAGGGCTTTGAAACAGCTTTGCTATAA
>w100.A6
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTATCAATGCTACTAATGCTA
CTGCCAGCAATAGCAGTATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGATGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCATGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTAAAAATAT
AACAGACAATGGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAAATATAAGAGA
AGCACATTGTAACATTAGTGAAAGTAAATGGAATGAAACTTTACAAAGGG
TAAGTGAAAAATTAAAAGAATACTTCCCTCAGAAGAATATAACATTTCAA
CCATCCTCAGGAGGGGACCTAGAAATTACAACACATAGCTTTAATTGTGG
AGGAGAATTTTTCTATTGCAATACATCAAGCCTGTTTAATAGAACATATA
TGGCTACTAGTACAGATATGGCTAATAGTACAGAAACTAACAGTACACGA
ATCATCACAATCCGCTGCAGGATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAACGATACG

Fig. 15 (cont.)
GATACGGAGACATTCAGACCTGAAGGAGGAAATATGAAGGACAATTGGAG
AAGTGAATTATATAAATATAAAGTGGTAGAAGTTAAGCCATTAGGAGTAG
CACCCACTAATGCAAGAAGGAGAGTGGTGGAGAGAGAAAAAAGAGCAGTG
GGAATGGGAGCTGTGTTCCTTGGGTTCTTGGGAGCGGCAGGAAGCACTAT
GGGCGCAGCATCAATAACGCTGACGGTACAGGCCAGACAATTATTGTCTG
GTATAGTGCAACAGCAAAGCAATTTGCTGAAGGCTATAGAGGCTCAACAG
CATATGTTGAAACTCACGGTCTGGGGCATTAAACAGCTCCAGGCAAGAGT
CCTGGCCTTGGAAAGATACCTAAAGGATCAACAGCTCCTAGGGATGTGGG
GCTGCTCTGGAAAACTCATCTGCACCACTAATGTATATTGGAACTCTAGT
TGGAGTAATAAAACTTATGGTGATATTTGGGATAACATGACCTGGATGCA
GTGGGAGAGAGAAATTAGCAATTATACAGACATAATATATGAATTGCTTG
AAGAATCACAAAACCAGCAGGAAAAGAATGAACAAGATTTACTAGCATTG
GACAGATGGAACAGTCTGTGGAATTGGTTTAACATAACAAATTGGCTGTG
GTATATAAAAATATTCATAATGATAGTAGGAGGCTTGATAGGTTTAAGAA
TAATTTTTGCTGTGCTTTCTTTAGTAAATAGAGTTAGGCAGGGATACTCA
CCTCTGTCATTGCAGACCCTTATCCCAAGCCCGAGGGGACCAGACAGGCC
CGGAGGAATCGAAGAAGAAGGTGGAGAGCAAGACAGAAACAGATCAACGC
GATTAGTGAGCGGATTCTTAGCGCTTGCCTGGGACGACCTGCGGAGCCTG
TGCCTTTTCATCTACCACCGATTGAGAGACTTCATATTAATTGCAGCGAG
AGCGGGGGAACTTCTGGGACGCAGCAGTCTCAAGGGACTACGGAGAGGGT
GGGAAGCCCTTAAGTATCTGGGAAGTCTTGTGCAGTATTGGGGCCTGGAA
CTAAAAAGGAGTGCTATTAGTCTATTGGATACCCTAGCAATAGCAGTAGG
TGAAGGAACAGATAGGATTCTAGAATTTGTATTAGGAATTTGTAGAGCTA
TCCGCAACATACCTACAAGAATAAGACAGGGCTTTGAAACAGCTTTGCTA
TAA
>w100.A12
ATGAGAGTGAGGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAG
GTTGACCCCACTCTGTGTCACTCTAAACTGTATCAATGCTACTAATGCTA
CTGCCAGCAATAGCAGTATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGATGGCAACTCTAGTCAATATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTAAAAATAT
AACAGACAATGGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAGACATAAGAGA
AGCACATTGTAACATTAGTGAAAGTAAATGGAATGAAACTTTACAAAGGG
TAAGTGAAAAATTAAAAGAATACTTCCCTGATAAGAATATAACATTTCAA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTAATAGTACAGATATGGCTAATAGTACAGAAACTAACAGTACACGA
ATCATCACACTCCACTGCAGAATAAAACAAATTATAAACATGTGGCAGGA
GGTGGGACGAGCAATGTATGCCCCTCCCATTGCAGGAAATATAACATGTA
TATCAAATATCACAGGACTACTATTGACAAGGGATGGAGGGAACGATACG
GATACGGAGACATTCAGACCTGAAGGAGGAAATATGAAGGACAATTGGAG
AAGTGAATTATATAAATATAAAGTGGTAGAAGTTAAGCCATTAGGAGTAG
CACCCACTAATGCAAGAAGGAGAGTGGTGGAGAGAGAAAAAAGAGCAGTG
GGAATGGGAGCTGTGTTCCTTGGGTTCTTGGGAGCGGCAGGAAGCACTAT
GGGCGCAGCATCAATAACGCTGACGGTACAGGCCAGACAACTATTGTCTG

Fig. 15 (cont.)
```
GTATAGTGCAACAGCAAAGCAATTTGCTGAAGGCTATAGAGGCTCAACAG
CATATGTTGAAACTCACGGTCTGGGGCATTAAACAGCTCCAGGCAAGAGT
CCTGGCCTTGGAAAGATACCTAAAGGATCAACAGCTCCTAGGGATGTGGG
GCTGCTCTGGAAAACTCATCTGCACCACTAATGTATATTGGAACTCTAGT
TGGAGTAATAAAACTTATGGTGATATTTGGGATAACATGACCTGGATGCA
GTGGGAGAGAGAAATTAGCAATTATACAGACATAATATATGAATTGCTTG
AAGAATCACAAAACCAGCAGGAAAAGAATGAACAAGATTTACTAGCATTG
GACAGATGGAACAGTCTGTGGAATTGGTTTAACATAACAAATTGGCTGTG
GTATATAAAAATATTCATAATGATAGTAGGAGGCTTGATAGGTTTAAGAA
TAATTTTTGCTGTGCTTTCTTTAGTAAATAGAGTTAGGCAGGGATACTCA
CCTCTGTCATTGCAGACCCTTATCCCAAGCCCGAGGGGACCAGACAGGCC
CGGAGGAATCGAAGAAGGAGGTGGAGAGCAAGACAGAAACAGATCAACGC
GATTAGTGAGCGGATTCTTAGCGCTTGCCTGGGACGACCTGCGGAGCCTG
TGCCTTTTCATCTACCACCGATTGAGAGACTTCATATTAATTGCAGCGAG
AGCGGGGGAACTTCTGGGACGCAGCAGTCTCAAGGGACTACGGAGAGGGT
GGGAAGCCCTTAAGTATCTGGGAAGTCTTGTGCAGTATTGGGGCCTGGAA
CTAAAAAGGAGTGCTATTAGTCTATTGGATACCCTAGCAATAGCAGTAGG
TGAAGGAACAGATAGGATTCTAGAATTTGTATTAGGAATTTGTAGAGCTA
TCCGCAACATACCTACAAGAATAAGACAGGGCTTTGAAACAGCTTTGCTA
TAA
>w100.A4
ATGAGAGTGATGGGGATACAGAGGAGTTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAG
GTTGACCCCACTCTGTGTCACTCTAAACTGTATCAATGCTACTAATGCTA
CTGCCAGCAATAGCAGTATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGATGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACGCATGGAATTAAGCCAGTGGTTTCAACTCAACTATTG
TTAAATGGTAGCCTAGCAGAAGGAGATAAATTTAGATCTAAAAATAT
AACAGACAATGGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAGACATAAGAGA
AGCACATTGTAACATTAGTGAAAGTAAATGGAATGAAACTTTACAAAGGG
TAAGTGAAAAATTAAAAGAATACTTCCCTGATAAGAATATAACATTTCAA
CCATCCTCAGGAGGGGACCTAGAAATTACAACACATAGCTTTAATTGTGG
AGGAGAATTTTTCTATTGCAATACATCAAATCTGTTTAATAGGACATATA
TGGTTAATAGTACAGATATGGCTAATAGTACAGAAACTAACAGTACACGA
ACCATCACAATCAGCTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAAAAACGAT
ACGGATACGGAGACATTCAGACCTGAAGGAGGAAATATGAAGGACAATTG
GAGAAGTGAATTATATAAATATAAAGTGGTAGAAGTTAAGCCATTAGGAG
TAGCACCCACTAATGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA
CAGCATATGTTGAAACTCACGGTCTGGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGTTGGAGTAATAAAACTTATGGTGATATTTGGGATAACATGACCTGGAT
```

Fig. 15 (cont.)
```
GCAGTGGGAGAGAGAAATTAGCAATTATACAGACATAATATATGAATTGC
TTGAAGAATCACAAAACCAGCAGGAAAAGAATGAACAAGATTTACTAGCA
TTGGACAGATGGAACAGTCTGTGGAATTGGTTTAACATAACAAATTGGCT
GTGGTATATAAAAATATTCATAATGATAGTAGGAGGCTTGATAGGTTTAA
GAATAATTTTTGCTGTGCTTTCTTTAGTAAATAGAGTTAGGCAGGGATAC
TCACCTCTGTCATTGCAGACCCTTATCCCAAGCCCGAGGGGACCAGACAG
GCCCGGAGGAATCGAAGAAGAAGGTGGAGAGCAAGACAGAAACAGATCAA
CGCGATTAGTGAGCGGATTCTTAGCGCTTGCCTGGGACGACCTGCGGAGC
CTGTGCCTTTTCATCTACCACCGATTGAGAGACTTCATATTAATTGCAGC
GAGAGCGGGGGAACTTCTGGGACGCAGCAGTCTCAAGGGACTACGGAGAG
GGTGGGAAGCCCTTAAGTATCTGGGAAGTCTTGTGCAGTATTGGGGCCTG
GAACTAAAAAGGAGTGCTATTAGTCTATTGGATACCCTAGCAATAGCAGT
AGGTGAAGGAACAGATAGGATTCTAGAATTTGTATTAGGAATTTGTAGAG
CTATCCGCAACATACCTACAAGAATAAGACAGGGCTTTGAAACAGCTTTG
CTATAA
>w100.A10
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCGATGCTACTAATGCTA
CTGCCAGCAATAGCAGTATATTAGGGGGAATGAAAAATTGCTCTTTCAAT
ATAACCACAGAATTAAGAGATAAGAGAGAGAAAAAGAATGCACTTTTTTA
TAAACTTGATATAGTACAACTAGATGGCAACTCTAGTCAGTATAGATTAA
TAAATTGTAATACCTCAGCCATAACACAAGCCTGTCCAAAGGTCTCTTTT
GACCCAATTCCTATACATTATTGCGCTCCAGCTGGTTATGCGATTCTAAA
GTGTAATAATAAGACATTCAATGGAACAGGACCATGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTAAAAACAT
AACAGACAATGGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAGACATAAGAGA
AGCACATTGTAACATTAGTGAAAGTAAATGGAATGAAACTTTACAAAGGG
TAAGTGAAAAATTAAAAGAATACTTCCCTGATAAGAATATAACATTTCAA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTAATAGTACAGATATGGCTAATAGTACAGAAACTAACAGTACACGA
ATCATCACAATCCGCTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAAAAATGAT
ACGGATACGGAGACATTCAGACCTGAAGGAGGAAATATGAAGGACAATTG
GAGAAGTGAATTATATAAATATAAAGTGGTAGAAGTTAAGCCATTAGGAG
TAGCACCCACTAATGCAAGAAGGAGAGTGGTGGAGAGAGAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA
CAGCATATGTTGAAACTCACGGTCTGGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGTTGGAGTAATAAAACTTATGGTGATATTTGGGATAACATGACCTGGAT
GCAGTGGGAGAGAGAAATTAGCAATTATACAGAACTAATATATGAATTGC
TTGAAGAATCACAAAACCAGCAGGAAAAGAATGAACAAGATTTACTAGCA
TTGGACAGATGGAACAGTCTGTGGAATTGGTTTAACATAACAAACTGGCT
GTGGTATATAAAAATATTCATAATGATAGTAGGAGGCTTGATAGGTTTAA
GAATAATTTTTGCTGTGCTTTCTTTAGTAAATAGAGTTAGGCAGGGATAC
```

Fig. 15 (cont.)
TCACCTCTGTCATTGCAGACCCTTATCCCAAGCCCGAGGGGACCAGACAG
GCCCGGAGGAATCGAAGAAGAAGGTGGAGAGCAAGACAGAAACAGATCAA
CGCGATTAGTGAGCGGATTCTTAGCGCTTGCCTGGGACGACCTGCGGAGC
CTGTGCCTTTTCATCTACCACCGATTGAGAGACTTCATATTAATTGCAGC
GAGAGCGGGGGAACTTCTGGGACGCAGCAGTCTCAAGGGACTACGGAGAG
GGTGGGAAGCCCTTAAGTATCTGGGAAGTCTTGTGCAGTATTGGGCCTG
GAACTAAAAAGGAGTGCTATTAGTCTATTGGATACCCTAGCAATAGCAGT
AGGTGAAGGAACAGATAGGATTCTAGAATTTGTATTAGGAATTTGTAGAG
CTATCCGCAACATACCTACAAGAATAAGACAGGGCTTTGAAACAGCTTTG
CTATAA
>w100.A3
ATGAGAGTGATGGGGATACAGAAGAATTGTCCACAATGGTGGATATGGAG
CATGTTAGGCTTGTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACTGATGCTAATGCTACTG
CCAGCAATAGCAGTATAATAAAGGGAATGAATAGCAGTATGATAGAGGAA
ATGAAAAATTGCTCTTTCAATATAACCACAGAATTAAGAGATAAGAGAGA
GAAAAAGAATGCACTTTTTTATAAACTTGATATAGTACAACTAGATGGCA
ACTCTAGTCAGTATAGATTAATAAATTGTAATACCTCAGTCATAACACAA
GCCTGTCCAAAGGTCTCTTTTGACCCAATTCCTATACATTATTGTGCTCC
AGCTGGTTATGCGATTCTAAAGTGTAATAATAAGACATTCAATGGAACAG
GACCGTGTAATAATGTCAGCACAGTACAATGTACACATGGAATTAAGCCA
GTGGTTTCAACTCAACTATTGTTAAATGGTAGCCTAGCAGAAGGAGAGAT
AATAATTAGATCTAAAAATATAACAGACAATGGCAAAACAATAATAGTAC
ATCTCAATGAATCTGTAAAGATTGAGTGTACGAGACCCAGTAATAACACA
AGAACAAGTATAAGAATAGGACCAGGACAAGCATTTTATGCAACAGGACA
AGTAATAGGAGACATAAGAGAAGCACATTGTAACATTAGTGAAAGTAAAT
GGAATGAAACTTTACAAAGGGTAAGTAAAAAATTAAAAGAATACTTCCCT
CAGAAAGATATAACATTTCAACCATCCTCAGGAGGGGACCTAGAAATTAC
AACACATAGCTTTAATTGTGGAGGAGAATTTTTCTATTGCAATACATCAA
GCCTGTTTAATAGGACATATATGGCTACTAGTACAGATATGGCTAATAGT
ACAGAAACTAACAGTACACGAATCATCACAATCCGCTGCAGAATAAAACA
AATTATAAACATGTGGCAGGAGGTGGGACGAGCAATGTATGCCCCTCCCA
TTGCAGGAAACATAACATGTATATCAAATATCACAGGACTACTATTGACA
AGGGATGGAGGAGAAAACGATACGGATACGGAGACATTCAGACCTGAAGG
AGGAAATATGAAGGACAATTGGAGAAGTGAATTATATAAATATAAAGTGG
TAGAAGTTAAGCCATTAGGAGTAGCACCCACTAATGCAAGAAGGAGAGTG
GTGGAGAGAGAAAAAAGAGCAGTGGGAATGGGAGCTGTGTTCCTTGGGTT
CTTGGGAGCGGCAGGAAGCACTATGGGCGCAGCATCAATAACGCTGACGG
TACAGGCCAGACAATTATTGTCTGGTATAGTGCAACAGCAAAGCAATTTG
CTGAAGGCTATAGAGGCTCAACAGCATATGTTGAAACTCACGGTCTGGGG
CATTAAACAGCTCCAGGCAAGAGTCCTGGCCTTGGAAAGATACCTAAAGG
ATCAACAGCTCCTAGGGATGTGGGCTGCTCTGGAAAACTCATCTGCACC
ACTAATGTATATTGGAACTCTAGTTGGAGTAATAAAACTTATGGTGATAT
TTGGGATAACATGACCTGGATGCAGTGGGAGAGAGAAATTAGCAATTATA
CAGACATAATATATGAATTGCTTGAAGAATCACAGAACCAGCAGGAAAAG
AATGAACAAGATTTACTAGCATTGGACAGATGGAACAGTCTGTGGAATTG
GTTTAACATAACAAATTGGCTGTGGTATATAAAAATATTCATAATGATAG
TAGGAGGCTTGATAGGTTTAAGAATAATTTTTGCTGTGCTTTCTTTAGTA
AATAGAGTTAGGCAGGGATACTCACCTCTGTCATTGCAGACCCTTATCCC
AAGCCCGAGGGGACCAGACAGGCCCGGAGGAATCGAAGAAGAAGGTGGAG
AGCAAGACAGAAACAGATCAACGCGATTAGTGAGCGGATTCTTAGCGCTT
GCCTGGGACGACCTGCGGAGCCTGTGCCTTTTCATCTACCACCGATTGAA
AGACTTCATATTAATTGCAGCGAGAGCGGGGGAACTTCTGGGACGCAGCA

Fig. 15 (cont.)
GTCTCAAGGGACTACGGAGAGGGTGGGAAGCCCTTAAGTATCTGGGAAGT
CTTGTGCAGTATTGGGGCCTGGAACTAAAAAGGAGTGCTATTAGTCTATT
GGATACCCTAGCAATAGCAGTAGGTGAAGGAACAGATAGGATTCTAGAAT
TTGTATTAGGAATTTGTAGAGCTATCCGCAACATACCTACAAGAATAAGA
CAGGGCTTTGAAACAGCTTTGCTATAA
>w100.B2
ATGAGAGTGATGGGGATACAGAGGAATTATCCACAATGGTGGATATGGAG
CATGTTAGGCTTGTGGATGCTAATGATTTGTAATGGGATGTGGGTCACAG
TCTACTATGGGGTACCTGTGTGGAAAAAAGCAAAACTACTCTATTTTGT
GCATCAGATGCTAAAGCATATGAGAAAGAAGTGCATAGTGTCTGGGCTAC
ACATGCCTGTGTACCCACAGACCCCAATCCACAAGAAATGGTTTTAAAAA
ATGTAACAGAAAATTTCAACATGTGGAAAAATGACATGGTAGATCAGATG
CATGAAGATGTAATTAGTTTATGGGATCAAAGCCTCAAGCCATGTGTAAA
GTTGACCCCACTCTGTGTCACTCTAAACTGTACCGATGCTAATGCTACTG
CCAGCAATAGCAGTATAATAAAGGGAATGAATAGCAGTATGATAGAGGCA
ATGAAAAATTGCTCTTTCAATATAACCACAGAATTAAGAGATAAGAGAGA
GAAAAAGAATGCACTTTTTTATAAACTTGATATAGTACAACTAGATGGCA
ACTCTAGTCAGTATAGATTAATAAATTGTAATACCTCAGTCATAACACAA
GCCTGTCCAAAGGTCTCTTTTGACCCAATTCCTATACATTATTGTGCTCC
AGCTGGTTATGCGATTCTAAAGTGTAATAATAAGACATTCAATGGAACAG
GACCGTGTAATAATGTCAGCACAGTACAATGTACACATGGAATTAAGCCA
GTGGTTTCAACTCAACTATTGTTAAATGGCAGCCTAGCAGAAGGAGAGAT
AATAATTAGATCTGAAAATATAACAAACAGTGCCAAAACAATAATAGTAC
ATCTCAATGAATCTGTAAAGATTGAGTGTACGAGACCCAGTAATAACACA
AGAACAAGTATAAGAATAGGACCAGGACAAGCATTTTATGCAACAGGACA
AGTAATAGGAGACATAAGAAAAGCACATTGTAACATTAGTGAAAGTAAAT
GGAATGAAACTTTACAAAGGGTAAGTAAAAAATTAAAAGAATACTTCCCT
GATAGGAATATAACATTTCAACCATCCTCAGGAGGGGACCCAGAAATTAC
AACACATAGCTTTAATTGTGGAGGAAAATTTTTCTATTGCAATACATCAA
GCCTGTTTAATAGAACATATATGGCTAATAGTACAGATATGGCTAATAGT
ACAGAAACTAACAGTACACGAATCATCACAATCCGCTGCAGAATAAAACA
AATTATAAACATGTGGCAGGAGGTGGGACGAGCAGTGTATGCCCCTCCCA
TTGCAGGAAACATAACATGTATATCAAATATCACAGGACTACTATTGACA
AGGGATGGAGGAAATAACAATACGGAGACATTCAGACCTGTAGGAGGAAA
TATGAAGGACAATTGGAGAAGTAAATTATATAAATATAAAGTGGTAGAAG
TTAAGCCATTAGGAGTAGCACCCACTAAGGCAAGAAGGAGAATGGTGGAG
AGAGAAAAAGAGCAGTGGGAATGGGAGCTGTGTTCCTTGGGTTCTTGGG
AGCGGCAGGAAGCACTATGGGCGCAGCATCAATAACGCTGACGGTACAGG
CCAGACAATTATTGTCTGGTATAGTGCAACAGCAAAGCAATTTGCTGAAG
GCTATAGAGGCTCAACAGCATATGTTGAAACTCACGGTCTGGGGCATTAA
ACAGCTCCAGGCAAGAGTCCTGGCCTTGGAAAAGATACCTAAAGGATCAAC
AGCTCCTAGGGATGTGGGGCTGCTCTGGAAAACTCATCTGCACCACTAAT
GTATATTGGAACTCTAGTTGGAGTAATAAAACTTATGGTGATATTTGGGA
TAACATGACCTGGATGCAGTGGGAGAGAGAAATTAGCAATTATACAGAAA
TAATATATGACTTGCTTGAAGAATCACAAAACCAGCAGGAAAAGAATGAA
CAAGATTTACTAGCATTGGACAGATGGAACAGTCTGTGGAATTGGTTTAA
CATAACAAAATGGCTGTGGTATATAAAAATATTCATAATGATAGTAGGAG
GCTTGATAGGTTTAAAAATAATTTTTGCTGTGCTTTCTTTAGTAAATAGA
GTTAGGCAGGGATACTCACCTCTGTCGTTGCAGACCCTTATCCCAAGCCC
GAGGGGACCAGACAGGCCCGGAGGAATCGAAGAAGAAGGTGGAGAGCAAG
ACAGAAACAGATCAACGCGATTAGTGAGCGGATTCTTAGCGCTTGCCTGG
GACGACCTGCGGAGCCTGTGCCTTTTCATCTACCACCGATTGAGAGACTT
TATATTAATTGCAGCGAGAGCGGGGAACTTCTGGGACGCAGCAGTCTCA
AGGGACTACGGAGAGGATGGGAAGCCCTTAAGTATCTGGAAGGTCTTGTG
CAGTATTGGGGCCTGGAACTAAAAAGGAGTGCTATTAGTCTATTGGATAC
CCTAGCAATAGCAGTAGGTGAAGGAACAGATAGGATTCTAGAATTTGTAT
TAGGAATTTGTAGAGCTATCCGCAACATACCTACAAGAATAAGACAGGGC
TTTGAAACAGCTTTGCTATAA Fig. 15 (cont.)
>w100.B4
ATGAGAGTGATGGGGAGGCAGAGGAATTATCCACAATGGTGGATATGGAG
CATGTTAGGCTTGTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGGAAAATGACATGGTAGATCAGATG
CATGAAGATGTAATTAGTTTATGGGATCAAAGCCTCAAGCCATGTGTAAA
GTTGACCCCACTCTGTGTCACTCTAAACTGTACCGATGCTAATGCTACTG
CCAGCAATACCAATGCTACTGCCAGCAATATCAATGCTACTGCCAGCAAG
AACAGTATAATAGAGGAAATGAAAAATTGCTCTTTCAATATAACCACAGA
ATTAAGAGATAAGAGAGAGAAAAAGTATGCACTTTTTTATAAACTTGATA
TAGTACAACTAGATGGCAACTCTAGTCAGTATAGATTAATAAATTGTAAT
ACCTCAGTCATAACACAAGCCTGTCCAAAGGTCTCTTTTGACCCAATTCC
TATACATTATTGTGCTCCAGCTGGTTATGCGATTCTAAAGTGTAATAATA
AGACATTCAATGGAACAGGACCGTGTAATAATGTCAGCACAGTACAATGT
ACACATGGAATTAAGCCAGTGGTTTCAACTCAACTATTGTTAAATGGTAG
CCTAGCAGAAGGAGAGATAATAATTAGATCTAAAAATATAACAGACAATG
GCAAAACAATAATAGTACATCTCAATGAATCTGTAAAGATTGAATGTACG
AGACCCAGTAATAACACAAGAACAAGTATAAGAATAGGACCAGGACAAGC
ATTTTATGCAACAGGACAAGTAATAGGAGACAATAAGAGAAGCACATTGTA
ACATTAGTGAAAGTAAATGGAATGAAACTTTACAAAGGGTAAGTAAAAAA
TTAAAAGAATACTTCCCTGATAAGAATATAACATTTCAATCATCCTCAGG
AGGGGACCCAGAAATTACAACACATAGCTTTAATTGTGGAGGAGAATTTT
TCTATTGCAATACATCAAGCCTGTTTAATAGGACATATATGGCTAATAGT
ACAGATATGGCTAATAGTACAGAAACTAACAGTACACGAATCATCACAAT
CCGCTGCAGAATAAAACAAATTATAAACATGTGGCAGGAGGTGGGACGAG
CAATGTATGCCCCTCCCATTGCAGGAAACATAACATGTATATCAAATATC
ACAGGACTACTATTGACAAGGGATGGAGGAAACAGCAGTGAGGAGACATT
CAGACCTGAAGGAGGAAATATGAAGGACAATTGGAGAAGTGAATTATATA
AATATAAAGTGGTAGAAGTTAAGCCATTAGGAGTAGCACCCACTAATGCA
AGAAGGAGAGTGGTGGAGAGAGAAAAAAGAGCAGTGGGAATGGGAGCTGT
GTTCCTTGGGTTCTTGGGAGCGGCAGGAAGCACTATGGGCGCAGCATCAA
TAACGCTGACGGTACAGGCCAGACAATTATTGTCTGGTATAGTGCAACAG
CAAAGCAATTTGCTGAAGGCTATAGAGGCTCAACAGCATATGTTGAAACT
CACGGTCTGGGGCATTAAACAGCTCCAGGCAAGAGTCCTGGCCTTGGAAA
GATACCTAAAGGATCAACAGCTCCTAGGGATGTGGGGCTGCTCTGGAAAA
CTCATCTGCACCACTAATGTATATTGGAACTCTAGTTGGAGTAATAAAAC
TTATGATGATATTTGGGATAACATGACCTGGATGCAGTGGGAGAGAGAAA
TTAGCAATTATACAGAAATGATATATGACTTGCTTGAAGAATCACAAAAC
CAGCAGGAAAAGAATGAACAAGATTTACTAGCATTGGACAGATGGAACAG
TCTGTGGAATTGGTTTAACATAACAAAATGGCTGTGGTATATAAAAATAT
TCATAATGATAGTAGGAGGCTTGATAGGTTTAAGAATAATTTTTGCTGTA
CTTTCTTTAGTAAATAGAGTTAGGCAGGGATACTCACCTCTGTCGTTGCA
GACCCTTATCCCAAGCCCGAGGGGACCAGACAGGCCCGGAGGAATCGAAG
AAGAAGGTGGAGAGCAAGACAGAAAGAGATCAACGCGATTAGTGAGCGGA
TTCTTAGCGCTTGTCTGGGACGACCTGCGGAGCCTGTGCCTTTTCATCTA
CCACCGATTGAGAGACTTCATATTAATTGCAGCGAGAGCGGGGGAACTTC
TGGGACGCAGCAGTCTCAAGGGACTACGGAGAGGGTGGGAAGCCCTTAAG
TATCTGGGAAGTCTTGTGCAGTATTGGGGCCTGGAACTAAAAAGGAGTGC
TATTAGTTTATTGGATACCCTAGCAATAGCAGTAGGTGAAGGAACAGATA
GGATTCTAGAATTTGTATTAGGAATTTGTAGAGCTATCCGCAACATACCT
ACAAGAATAAGACAGGGCTTTGAAACAGCTTTGCTATAA
>w100.C7
ATGAGAGTGATGGGGATACAGAGGAATTATCCACAATGGTGGATATGGAG
CATGTTAGGCTTGTGGATGCTAATGACTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCCAC

Fig. 15 (cont.)
```
ACATGCCTGTGTACCCACAGACCCCAATCCACAAGAAATGGTTTTAAAAA
ATGTAACAGAAAATTTCAACATGTGGGAAAATGACATGGTAGATCAGATG
CATGAAGATGTAATTAGTTTATGGGATCAAAGCCTCAAGCCATGTGTAAA
GTTGACCCCACTCTGTGTCACTCTAAACTGTACCGATGCTAATGCTACTG
CCAGCAATACCAATGCTACTGCCAGCAATATCAATGCTACTGCCAGCAAG
AGCAGTATAATAGAGGAAATGAAAAATTGCTCTTTCAATATAACCACAGA
ATTAAGAGATAAGAGAGAGAAAAAGTATGCACTTTTTTATAAACTTGATA
TAGTACAACTAGATGGCAACTCTAGTCAGTATAGATTAATAAATTGTAAT
ACCTCAGTCATAACCCAAGCCTGTCCAAAGGTCTCTTTTGACCCAATTCC
TATACATTATTGTGCTCCAGCTGGTTATGCGATTCTAAAGTGTAATAATA
AGACATTCAATGGAACAGGACCGTGTAATAATGTCAGCACAGTACAATGT
ACACATGGAATTAAGCCAGTGGTTTCAACTCAACTATTGTTAAATGGTAG
CCTAGCAGAAGGAGAGATAATAATTAGATCTAAAAATATAACAGACAATG
GCAAAACAATAATAGTACATCTCAATGAATCTGTAAAGATTGAATGTACG
AGACCCAGTAATAACACAAGAACAAGTATAAGAATAGGACCAGGACAAGC
ATTTTATGCAACAGGACAAGTAATAGGAGACATAAGAGAAGCACATTGTA
ACATTAGTGAAAGTAAATGGAATGAAACTTTACAAAGGGTAAGTAAAAAA
TTAAAAGAATACTTCCCTGATAAGAATATAACATTTCAATCATCCTCAGG
AGGGGACCCAGAAATTACAACACATAGCTTTAATTGTGGAGGAGAATTTT
TCTATTGCAATACATCAAGCCTGTTTAATAGGACATATATGGCTAATAGT
ACAGATATGGCTAATAGTACAGAAACTAACAGTACACGAATCATCACAAT
CCACTGCAGAATAAAACAAATTATAAACATGTGGCAGGAGGTGGGACGAG
CAATGTATGCCCCTCCCATTGCAGGAAACATAACATGTATATCAAATATC
ACAGGACTACTATTGACAAGGGATGGAGGAGAAAACAATGGAGGAAAAAA
CAATACAGAGACATTCAGACCTGGAGGAGGAAATATGAAGGACAATTGGA
GAAGTGAATTATATAAATATAAAGTGGTAGAAGTTAAGCCATTAGGAGTA
GCACCCACTAAGGCAAGAAGGAGAGTGGTGGAGAGAGAAAAAAGAGCAGT
GGGAATGGGAGCTGTGTTCCTTGGGTTCTTGGGAGCGGCAGGAAGCACTA
TGGGCGCAGCATCAATAACGCTGACGGTACAGGCCAGACAATTATTGTCT
GGTATAGTGCAACAGCAAATTTGCTGAAGGCTATAGAGGCTCAACA
GCATATGTTGAAACTCACGGTCTGGGGCATTAAACAGCTCCAGGCAAGAG
TCCTGGCCTTGGAAAGATACCTAAAGGATCAACAGCTCCTAGGGATGTGG
GGCTGCTCTGGAAAACTCATCTGCACCACTAATGTATATTGGAACTCTAG
TTGGAGTAATAAAACTTATGGTGATATTTGGGATAACATGACCTGGATGC
AGTGGGAGAGAGAAATTAGCAATTATACAGACATAATATATGACTTGCTT
GAAGAATCACAAAACCAGCAGGAAAAGAATGAACAAGATTTACTAGCATT
GGACAGATGGAACAGTCTGTGGAATTGGTTTAACATAACAAAATGGCTGT
GGTATATAAAAATATTCATAATGATAGTAGGAGGCTTGATAGGTTTAAGA
ATAATTTTTGCTGTGCTTTCTTTAGTAAATAGAGTTAGGCAGGGATACTC
ACCTCTGTCATTGCAGACCCTTATCCCAAGCCCGAGGGGACCAGACAGGC
CCGGAGGAATCGAAGAAGAAGGTGGAGAGCAAGACAGAAACAGATCAACG
CGATTAGTGAGCGGATTCTTAGCGCTTGCCTGGGACGACCTGCGGAGCCT
GTGCCTTTTCATCTACCACCGATTGAGAGACTTCATATTAATTGCAGCGA
GAGCGGGGGAACTTCTGGGACGCAGCAGTCTCAAGGGACTACGGAGAGGG
TGGGAAGCCCTTAAGTATCTGGGAGGTCTTGTGCAGTATTGGGGCCTGGA
ACTAAAAAGGAGTGCTATTAGTCTATTGGATACCCTAGCAATAGCAGTAG
GTGAAGGAACAGATAGGATTCTAGAATTTGTATTAGGAATTTGTAGAGCT
ATCCGCAACATACCTACAAGAATAAGACAGGGCTTTGAAACAGCTTTGCT
ATAA
>w100.b7
ACGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAATGACATGGCGGATCAGATG
CATGAAGATGTAATTAGTTTATGGGATCAAAGCCTCAAGCCATGTGTAAA
GTTGACCCCACTCTGTGTCACTCTAAACTGTACCGATGCTAATGCTACTG
```

Fig. 15 (cont.)
CCAGCAATATCAATGCTACTGCCAGCAAGAGCAGTATAATAGAGGAAATG
AAAAATTGCTCTTTCAATATAACCACAGAATTAAGAGATAAGAGAGAGAA
AAAGTATGCACTTTTTTATAAACTTGATATAGTACAACTAGATGGCAACT
CTAGTCAGTATAGATTAATAAATTGTAATACCTCAGTCATAACCCAAGCC
TGTCCAAAGGTCTCTTTTGACCCAATTCCTATACATTATTGTGCTCCAGC
TGGTTATGCGATTCTAAAGTGTAATAATAAGACATTCAATGGAACAGGAC
CGTGTAATAATGTCAGCACAGTACAATGTACACATGGAATTAAGCCAGTG
GTTTCAACTCAACTATTGTTAAATGGTAGCCTAGCAGAAGGAGAGATAAT
AATTAGATCTGAAAATATAACAGACAATAGCAAAACAATAATAGTACATC
TCAATGAATCTGTAAAGATTGAGTGTACAAGACCCAGTAATAACACAAGA
ACAAGTATAAGAATAGGACCAGGACAAGCATTTTATGCAACAGGACAAGT
AATAGGAGACATAAGAGAAGCACATTGTAACATTAGTGAAAGTAAATGGA
ATGAAACTTTACAAAGGGTAAGTAAAAAATTAAAAGAATACTTCCCTGAT
AAGAATATAACATTTCAACCATCCTCAGGAGGGGACCCAGAAATTACAAC
ACATAGCTTTAATTGTGGAGGAGAATTTTTCTATTGCAATACATCAAGCC
TGTTTAATAGGACATACATGGCTAATAGTACAGAAACTAACAGTACACGA
ACCATCACACTCCACTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAGAAAACACA
AGGGATGGAGGAAATAACAATACGGAGACATTCAGACCTGAAGGAGGAAA
TATGAAGGACAATTGGAGAAGTGAATTATATAAATATAAAGTGGTAGAAG
TTAAGCCATTAGGAGTAGCACCCACTAAGGCAAGAAGGAGAGTGGTGGAG
AGAGAAAAAGAGCAGTGGGAATGGGAGCTGTGTTCCTTGGGTTCTTGGG
AGCGGCAGGAAGCACTATGGGCGCAGCATCAATAACGCTGACGGTACAGG
CCAGGCAATTATTGTCTGGTATAGTGCAACAGCAAAGCAATTTGCTGAAG
GCTATAGAGGCTCAACAGCATATGTTGAAACTCACGGTCTGGGGCATTAA
ACAGCTCCAGGCAAGAGTCCTGGCCTTGGAAAGATACCTAAAGGATCAAC
AGCTCCTAGGGATGTGGGGCTGCTCTGGAAAACTCATCTGCACCACTAAT
GTATATTGGAACTCTAGTTGGAGTAATAAAACTTATGGTGATATTTGGGA
TAACATGACCTGGATGCAGTGGGAGAGAGAAATTAGCAATTATACAGACA
TAATATATGAATTGCTTGAAGAATCACAAAACCAGCAGGAAAAGAATGAA
CAAGATTTACTAGCATTGGACAGATGGAACAGTCTGTGGAATTGGTTTAA
CATAACAAATTGGCTGTGGTATATAAAAATATTCATAATGATAGTAGGAG
GCTTGATAGGTTTAAGAATAATTTTTGCTGTGCTTTCTTTAGTAAATAGA
GTTAGGCAGGGATACTCACCTCTGTCATTGCAGACCCTTATCCCAAGCCC
GAGGGGACCAGACAGGCCCGGAGGAATCGAAGAAGAAGGTGGAGAGCAAG
ACAGAAACAGATCAACGCGATTAGTGAGCGGATTCTTAGCGCTTGCCTGG
GACGACCTGCGGAGCCTGTGCCTTTTCATCTACCACCGATTGAGAGACTT
CATATTAATTGCAGCGAGAGCGGGGGAACTTCTGGGACGCAGCAGTCTCA
AGGGACTACGGAGAGGGTGGGAAGCCCTTAAGTATCTGGGAAGTCTTGTG
CAGTATTGGGGCCTGGAACTAAAAAGGAGTGCTATTAGTCTATTGGATAC
CCTAGCAATAGCAGTAGGTGAAGGAACAGATAGGATTCTAGAATTTGTAT
TAGGAATTTGTAGAGCTATCCGCAACATACCTACAAGAATAAGACAGGGC
TTTGAAACAGCTTTGCTATAA
>w100.B6
ATGAAAGTGAGGGGGATACAGAGGAATTATCCACAATGGTGGATATGGAG
CATGTTAGGCTTGTGGATGCTAATGATTTGTAATGGGATGTGGGTCACAG
TCTATTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAGAAA
ATGTAACAGAAAATTTCAACATGTGGAAAAATGACATGGCGGATCAGATG
CATGAAGATGTAATTAGTTTATGGGATCAAAGCCTCAAGCCATGTGTAAA
GTTGACCCCACTCTGTGTCACTCTAAACTGTACCGATGCTAATGCTACTG
CCAGCAATACCAATGCTACTGCCAGCAATATCAATGCTACTGCCAGCAAG
AGCAGTATAATAGAGGAAATGAAAAATTGCTCTTTCAATATAACCACAGA
ATTAAGAGATAAGAGAGAGAAAAAGTATGCACTTTTTTATAAACTTGATA
TAGTACAACTAGATGGCAACTCTAGTCAGTATAGATTAATAAATTGTAAT
ACCTCAGTCATAACCCAAGCCTGTCCAAAGGTCTCTTTTGACCCAATTCC Fig. 15 (cont.)
TATACATTATTGTGCTCCAGCTGGTTATGCGATTCTAAAGTGTAATAATA
AGACATTCAATGGAACAGGACCGTGTAATAATGTCAGCACAGTACAATGT
ACACATGGAATTAAGCCAGTGGTTTCAACTCAACTATTGTTAAATGGTAG
CCTAGCAGAAGGAGAGATAATAATTAGATCTGAAAATATAACAGACAATA
GCAAAACAATAATAGTACATCTCAATGAATCTGTAAAGATTGAGTGTACA
AGACCCAGTAATAACACAAGAACAAGTATAAGGATAGGACCAGGACAAGC
ATTTTATGCAACAGGACAAGTAATAGGAGACATAAGAGAAGCACATTGTA
ACATTAGTGAAAGTAAATGGAATGAAACTTTACAAAGGGTAAGTAAAAAA
TTAAAAGAATACTTCCCTGATAAGAATATAACATTTCAACCATCCTCAGG
AGGGGACCCAGAAATTACAACACATAGCTTTAATTGTGGAGGAGAATTTT
TCTATTGCAATACATCAAGCCTGTTTAATAGGACATACATGGCTAATAGT
ACAGAAACTAACAGTACACGAACCATCACACTCCACTGCAGAATAAAACA
AATTATAAACATGTGGCAGGAGGTGGGACGAGCAATGTATGCCCCTCCCA
TTGCAGGGAACATAACATGTATATCAAATATCACAGGACTACTATTGACA
AGGGATGGAGGAGAAAACACAAGGGATGGAGGAAATAACAATACGGAGAC
ATTCAGACCTGAAGGAGGAAATATGAAGGACAATTGGAGAAGTGAATTAT
ATAAATATAAAGTGGTAGAAGTTAAGCCATTAGGAGTAGCACCCACTAAG
GCAAGAAGGAGAGTGGTGGAGAGAGAAAAAGAGCAGTGGGAATGGGAGC
TGTGTTCCTTGGGTTCTTGGGAGCGGCAGGAAGCACTATGGGCGCAGCAT
CAATAACGCTGACGGTACAGGCCAGACAATTATTGTCTGGTATAGTGCAA
CAGCAAAGCAATTTGCTGAAGGCTATAGAGGCTCAACAGCATATGTTGAA
ACTCACGGTCTGGGGCATTAAACAGCTCCAGGCAAGAGTCCTGGCCTTGG
AAAGATACCTAAAGGATCAACAGCTCCTAGGGATGTGGGGCTGCTCTGGA
AAACTCATCTGCACCACTAATGTATATTGGAACTCTAGTTGGAGTAATAA
AACTTATGGTGATATTTGGGATAACATGACCTGGATGCAGTGGGAGAGAG
AAATTAGCAATTATACAGACATAATATATGACTTGCTTGAAGAATCACAA
AACCAGCAGGAAAAGAATGAACAAGATTTACTAGCATTGGACAGATGGAA
CAGTCTGTGGAATTGGTTTAACATAACAAAATGGCTGTGGTATATAAAAA
TATTCATAATGATAGTAGGAGGCTTGATAGGTTTAAGAATAATTTTTGCT
GTGCTTTCTTTAGTAAATAGAGTTAGGCAGGGATACTCACCTCTGTCGTT
ACAGACCCTTATCCCAAGCCCGAGGGGACCAGACAGGCCCGGAGGAATCG
AAGAAGAAGGTGGAGAGCAAGACAGAAACAGATCAACGCGATTAGTGAGC
GGATTCTTAGCGCTTGCCTGGGACGACCTGCGGAGCCTGTGCCTTTTCAT
CTACCACCGATTGAGAGACTTCATATTAATTGCAGCGAGAGCGGGGGAAC
TTCTGGGACGCAGCAGTCTCAAGGGACTACGGAGAGGGTGGGAAGCCCTT
AAGTATCTGGGAGGTCTTGTGCAGTATTGGGGCCTGGAACTAAAAAGGAG
TGCTATTAGTCTATTGGATACCCTAGCAATAGCAGTAGGTGAAGGAACAG
ATAGGATTCTAGAATTTGTATTAGGAATTTGTAGAGCTATCCGCAACATA
CCTACAAGAATAAGACAGGGCTTTGAAACAGCTTTGCTATAA
>w100.A13
ATGAGAGTGATGGGGATACAGAGGAATTATCCACAATGGTGGATATGGAG
CATGTTAGGCTTGTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGCGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGCGGATCAGATG
CATGAAGATGTAATTAGTTTATGGGATCAAAGCCTCAAGCCATGTGTAAA
GTTGACCCCACTCTGTGTCACTCTAAACTGTACCGATGCTAATGCTACTG
CCAGCAATGCTAATGCTACTGCCAGCAATACCAATGCTACTGTCAGCAAT
AGCAGTATAATAGGGAAATGAAAAATTGCTCTTTCAATATAACCACAGA
ATTAAGAGATAAGAGAGAGAAAAGTATGCACTTTTTTATAAACTTGATA
TAGTACAACTAGATGGCAACTCTAGTCAGTATAGATTAATAAATTGTAAT
ACCTCAGTCATAACCCAAGCCTGTCCAAAGGTCTCTTTTGACCCAATTCC
TATACATTATTGTGCTCCAGCTGGTTATGCGATTCTAAAGTGTAATAATA
AGACATTCAATGGAACAGGACCGTGTAATAATGTCAGCACAGTACAATGT
ACACATGGAATTAAGCCAGTGGTTTCAACTCAACTACTGTTAAATGGTAG
CCTAGCAGAAGGAGAGATAATAATTAGATCTGAAAATATAACAAACAGTG
CCAAAACAATAATAGTACATCTCAATGAATCTGTAAAGATTGAGTGTACG

Fig. 15 (cont.)

```
AGACCCAGTAATAACACAAGAACAAGTATAAGAATAGGACCAGGACAAGC
ATTTTATGCAACAGGACAAGTAATAGGAGACATAAGAAAAGCACATTGTA
ACATTAGTGAAAGTAAATGGAATGAAACTTTACAAAGGGTAAGTAAAAAA
TTAAAAGAATACTTCCCTCATAAGAATATAACATTTCAACCATCCTCAGG
AGGGGACCCAGAAATTACAACGCATAGTTTTAATTGTGGAGGAGAATTTT
TCTATTGCAATACATCAAGCCTGTTTAATAGGACATACATGGCTAATAGT
ACAGAAACTAACAGTACACGAACCATCACACTCCACTGCAGAATAAAACA
AATTATAAACATGTGGCAGGAGGTGGGACGAGCAATGTATGCCCCTCCCA
TTGCAGGAAACATAACATGTATATCAAATATCACAGGACTACTATTGACA
AGGGATGGAGGAGAAAACACAAGGGATGGAGGAAATAACAATACGGAGAC
ATTCAGACCTGGAGGAGGAAATATGAAGGACAATTGGAGAAGTGAATTAT
ATAAATATAAAGTGGTAGAAGTTAAGCCATTAGGAGTAGCACCCACTAAT
GCAAGAAGGAGAGTGGTGGAGAGAGAAAAAAGAGCAGTGGGAATGGGAGC
TGTGTTCCTTGGGTTCTTGGGAGCGGCAGGAAGCACTATGGGCGCAGCAT
CAATAACGCTGACGGTACAGGCCAGACAATTATTGTCTGGTATAGTGCAA
CAGCAAAGCAATTTGCTGAAGGCTATAGAGGCTCAACAGCATATGTTGAA
ACTCACGGTCTGGGGCATCAAACAGCTCCAGGCAAGAGTCCTGGCCTTGG
AAAGATACCTAAAGGATCAACAGCTCCTAGGGATGTGGGGCTGCTCTGGA
AAACTCATCTGCACCACTAATGTATATTGGAACTCTAGTTGGAGTAATAA
AACTTATGGTGATATTTGGGATAACATGACCTGGATGCAGTGGGAGAGAG
AAATTAGCAATTATACAGACATAATATATGACTTGCTTGAAGAATCACAA
AACCAGCAGGAAAAGAATGAACAAGATTTACTAGCATTGGACAGATGGAA
CAGTCTGTGGAATTGGTTTAACATAACAAAATGGCTGTGGTATATAAAAA
TATTCATAATGATAGTAGGAGGCTTGATAGGTTTAAGAATAATTTTTGCT
GTGCTTTCTTTAGTAAATAGAGTTAGGCAGGGATACTCACCTCTGTCGTT
GCAGACCCTTATCCCAAGCCCGAGGGGACCAGACAGGCCCGGAGGAATCG
AAGAAGAAGGTGGAGAGCAAGACAGAAACAGATCAACGCGATTAGTGAGC
GGATTCTTAGCGCTTGCCTGGGACGACCTGCGGAGCCTGTGCCTTTTCAT
CTACCACCGATTGAGAGACTTCATATTAATTGCAGCGAGAGCGGGGGAAC
TTCTGGGACGCAGCAGTCTCAAGGGACTACGGAGAGGATGGGAAGCCCTT
AAGTATCTGGGAGGTCTTGTGCAGTATTGGGGCCTGGAACTAAAAAGGAG
TGCTATTAGTCTATTGGATACCCTAGCAATAGCAGTAGGTGAAGGAACAG
ATAGGATTCTAGAATTTGTATTAGGAATTTGTAGCTATCCGCAACATA
CCTACAAGAATAAGACAGGGCTTTGAAACAGCTTTGCTATAA
>w136.B10
ATGAGAGTGATGGGGATACAGAGGAGTTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTTAACATGTGGAAAAATGACATGGTGGATCAGATG
CATGAAGATGTAATTAGTTTTATGGGATCAAAGCCTCAAGCCATGTGTAAA
GTTGACCCCACTCTGCGTCACTCTAAGCTGTATCAATGCTACTAATGCTA
CTGACAGCAATAACAGTATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTATATGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACTCATGGAATTAAGCCAGTGGTTTCAACTCAACTATTG
TTAAATGGTAGCCTAGCAGAAGGAGAGATAATAATTAGATCTAAAAATAT
AACAGACAATGGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAAATATAAGAGA
AGCACATTGTAACATTAGTGAAAGTAAATGGAATGAAACTTTACAAAGGG
TAAGTGAAAAATTAAAAGAATACTTCCCTGATAAGAATATAACATTTCAA
CCATCCTCAGGAGGGGACCTAGAAATTACAACACATAGCTTTAATTGTGG
AGGAGAATTTTTCTATTGCAATACATCTAGCCTGTTTAATAGGACATATA
```

Fig. 15 (cont.)
TGGCTACTAGTACAGATATGGCTAATAGTACAGAAACTAACAGTACACGA
ATCATCACAATCCACTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAACAATACA
GAGGATACGGAGACATTCAGACCTGAAGGAGGAAATATGAAGGACAATTG
GAGAAGTGAATTATATAAATATAAAGTGGTAGAAGTTAAGCCATTAGGAG
TAGCACCCACTAATGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA
CAGCATATGTTGAAACTCACGGTCTGGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGTTGGAGTAATAAAACTTATAGTGATATTTGGGATAACATGACCTGGAT
GCAGTGGGAGAGAGAAATTAGCAATTATACAGACATGATATATGAATTGC
TTGAAGAATCACAAAACCAGCAGGAAAAGAATGAACAAGATTTACTAGCA
TTGGACAGATGGAACAGTCTGTGGAATTGGTTTAACATAACAAATTGGCT
GTGGTATATAAAAATATTCATAATGATAGTAGGAGGCTTGATAGGTTTAA
GAATAATTTTTGCTGTGCTTTCTTTAGTAAATAGAGTTAGGCAGGGATAC
TCACCTCTGTCATTGCAGACCCTTATCCCAAGCCCGAGGGGACCAGACAG
GCCCGGAGGAATCGAAGAAGAAGGTGGAGAGCAAGACAGAAACAGATCAA
CGCGATTAGTGAGCGGATTCTTAGCGCTTGCCTGGGACGACCTGCGGAGC
CTGTGCCTTTTCATCTACCACCGATTGAGAGACTTCATATTAATTGCAGC
GAGAGCGGGGGAACTTCTGGGACGCAGCAGTCTCAAGGGACTACGGAGAG
GGTGGGAAGCCCTTAAGTATCTGGGAAGTCTTGGGCAGTATTGGGGCCTG
GAACTAAAAAGGAGTGCTATTAGTCTATTGGATACCCTAGCAATAGCAGT
AGGTGAGGGAACAGATAGGATTCTAGAATTTGTATTAGGAATTTGTAGAG
CTATCCGCAACATACCTACAAGAATAAGACAGGGCTTTGAAACAGCTTTG
CTATAA
>w136.B27
ATGAGAGTGAGGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTTAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTATCAATGCTACTAATGCTA
CTGCCAGCAATAGCAATATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGGTGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTAAAAATAT
AACAGACAATAGCAAAACAATAATAGTACATCTCAATGAATCTGTAAAGA
TTGAGTGTACGAGACCCAGTAATAACAAGTATAAGAATAGGA
CCAGGACAAGCATTTTATGCAACAGGACAAGTAATAGGAAATATAAGAGA
AGCACATTGTAACATTAGTGAAAGTAAATGGAATGAAACTTTACAAAGGG
TAAGTGAAAAATTAAAAGAATACTTCCCTGATAAGAATATAACATTTCAA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTAATAGTACAGATATGGCTAATAGTACAGAAACTAACAGTACACGA
ATCATCACACTCCACTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAACAATACA
GAGGATACGGAGACATTCAGACCTGAAGGAGGAAATATGAAGGACAATTG

Fig. 15 (cont.)
GAGAAGTGAATTATATAAATATAAAGTGGTAGAAGTTAAGCCATTAGGAG
TAGCACCCACTAATGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA
CAGCATATGTTGAAACTCACGGTCTGGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGCTGGAGTAATAAAACTTATAGTGATATTTGGGATAACATGACCTGGAT
GCAGTGGGAGAGAGAAATTAGCAATTATACAGACATGATATATGAATTGC
TTGAAGAATCACAAAACCAGCAGGAAAAGAATGAACAAGATTTACTAGCA
TTGGACAGATGGAACAGTCTGTGGAATTGGTTTAACATAACAAATTGGCT
GTGGTATATAAAAATATTCATAATGATAGTAGGAGGCTTGATAGGTTTAA
GAATAATTTTTGCTGTGCTTTCTTTAGTAAATAGAGTTAGGCAGGGATAC
TCACCTCTGTCATTGCAGACCCTTATCCCAAGCCCGAGGGGACCAGACAG
GCCCGGAGGAATCGAAGAAGAAGGTGGAGAGCAAGACAGAAACAGATCAA
CGCGATTAGTGAGCGGATTCTTAGCGCTTGCCTGGAACGACCTGCGGAGC
CTGTGCCTTTTCATCTACCACCGATTGAGAGACTTCATATTAATTGCAGC
GAGAGCGGGGGAACTTCTGGGACGCAGCAGTCTCAAGGGACTACGGAGAG
GGTGGGAAGCCCTTAAGTATCTGGGAAGTCTTGTGCAGTATTGGGCCTG
GAACTAAAAAGGAGTGCTATTAGTCTATTGGATACCCTAGCAATAGCAGT
AGGTGAGGGAACAGATAGGATTCTAGAATTTGTATTAGGAATTTGTAGAG
CTATCCGCAACATACCTACAAGAATAAGACAGGGCTTTGAAACGGCTTTG
CTATAA
>w136.B12
ACGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTATCAATGCTACTAATGCTA
CTGACAGCAATAGCAATATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGGTGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTAAAAATAT
AACAGACAATAGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAAATATAAGAGA
AGCACATTGTAACATTAGTGAAAGTAAATGGACTGAGACTTTACAAAGGG
TAAGTGAAAAATTAAAAAAATACTTCCCTGTAAGAATATAACATTTCGA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTACTAGTACAGATATGGCTAATAGTACAGAAATTAACAGTACACGA
ATCATCACAATCCACTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAACAATACA
GAGGATACGGAGACATTCAGACCTGAAGGAGGAAATATGAAGGACAATTG
GAGAAGTGAATTATATAAATATAAAGTGGTAGAAGTTAAGCCATTAGGAG
TAGCACCCACTAATGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA Fig. 15 (cont.)
CAGCATATGTTGAAACTCACGGTCTGGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGCTGGAGTAATAAAACTTATGATGATATTTGGGATAACATGACCTGGAT
GCAGTGGGAGAGAGAAATTAGCAATTATACAAACATAATATATGAATTGC
TTGAAGAATCACAAAACCAGCAGGAAAAGAATGAACAAGATTTACTAGCA
TTGGACAGATGGAACAGTCTGTGGAATTGGTTTAACATAACAAATTGGCT
GTGGTATATAAAAATATTCATAATGATAGTAGGAGGCTTGATAGGTTTAA
GAATAATTTTTGCTGTGCTTTCTTTAGTAAATAGAGTTAGGCAGGGATAC
TCACCTCTGTCATTGCAGACCCTTATCCCAAGCCGAGGGGACCAGACAG
GCCCGGAGGAATCGAAGAAGAAGGTGGAGAGCAAGACAGAAACAGATCAA
CGCGATTAGTGAGCGGATTCTTAGCGCTTGCCTGGGACGACCTGCGGAGC
CTGTGCCTTTTCATCTACCACCGATTGAGAGACTTCATATTAATTGCAGC
GAGAGCGGGGGAACTTCTGGGACGCAGCAGTCTCAAGGGACTACGGAGAG
GGTGGGAAGCCCTTAAGTATCTGGGAAGTCTTGTGCAGTATTGGGGCCTG
GAACTAAAAAGGAGTGCTATTAGTCTATTGGATACCCTAGCAATAGCAGT
AGGTGAGGGAACAGATAGGATTCTAGAATTTGTATTAGGAATTTGTAGAG
CTATCCGCAACATACCTACAAGAATAAGACAGGGCTTTGAAACAGCTTTG
CTATAA
>w136.B4
ATGAGAGTGAGGGGGATACAGAGGAGTTATCCACAATGGTGGATATGGAG
CATGTTAGGCTTTTGGATGCTAATGATTTGTAATGGGATGTGGGTCACAG
TCTATTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTATCAATGCTACTAATGCTA
CTGACAGCAATAGCAATATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGGTGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTAAAAATAT
AACAGACAATAGCAAAACAATAATAGCATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAAATATAAGAGA
AGCACATTGTAACATTAGTGAAAGTAAATGGAATGAGACTTTACAAAGGG
TAAGTGAAAAATTAAAAAAATACTTCCCTGATAAGAATATAACATTTCGA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTACTAGTACAGATATGGCTAATAGTACAGAAACTAACAGTACACGA
ATCATCACAATCCACTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAACAATACA
GAGGATACGGAGACATTCAGACCTGAAGGAGGAAATATGAAGGACAATTG
GAGAAGTGAATTATATAAATATAAAGTGGTAGAAGTTAAGCCATTAGGAG
TAGCACCCACTAATGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA
CAGCATATGTTGAAACTCACGGTCTGGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGCTGGAGTAATAAAACTTATGATGATATTTGGGATAACATGACCTGGAT
GCAGTGGGAGAGAGAAATTAGCAATTATACAAACATAATATATGAATTGC Fig. 15 (cont.)
TTGAAGAATCACAAAACCAGCAGGAAAAGAATGAACAAGATTTACTAGCA
TTGGACAGATGGAACAGTCTGTGGAATTGGTTTAACATAACAAATTGGCT
GTGGTATATAAAAATATTCATAATGATAGTAGGAGGCTTGATAGGTTTAA
GAATAATTTTTGCTGTGCTTTCTTTAGTAAATAGAGTTAGGCAGGGATAC
TCACCTCTGTCATTGCAGACCCTTATCCCAAGCCCGAGGGGACCAGACAG
GCCCGGAGGAATCGAAGAAGAAGGTGGAGAGCAAGACAGAAACAGATCAA
CGCGATTAGTGAGCGGATTCTTAGCGCTTGCCTGGGACGACCTGCGGAGC
CTGTGCCTTTTCATCTACCACCGATTGAGAGACTTCATATTAATTGCAGC
GAGAGCGGGGGAACTTCTGGGACGCAGCAGTCTCAAGGGACTACGGAGAG
GGTGGGAAGCCCTTAAGTATCTGGGAAGTCTTGTGCAGTATTGGGGCCTG
GAACTAAAAAGGAGTGCTATTAGTCTATTGGATACCCTAGCAATAGCAGT
AGGTGAGGGAACAGATAGGATTCTAGAATTTGTATTAGGAATTTGTAGAG
CTATCCGCAACATACCTACAAGAATAAGACAGGGCTTTGAAACAGCTTTG
CTATAA
>w136.B29
ATGAGAGTGAGGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAATGTATCAATGCTACTAATGCTA
CTGACAGCAATAGCAATATATTAGGGGAATGAAAAATTGCTCTTTCAAT
ATAACCACAGAATTAAGAGATAAGAGAGAGAAAAAGAATGCACTTTTTTA
TAAACTTGATATAGTACAACTAGGTGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACACATGGAATTAAGCCAGTGGTTTCAACTCAACTATTG
TTAAATGGTAGCCTAGCAGAAGGAGATAATAGTACAGAAACTAACAGACGA
AACAGACAATAGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAAATATAAGAGA
AGCACATTGTAACATTAGTGAAAGTAAATGGAATGAGACTTTACAAAGGG
TAAGTGAAAAATTAAAAAAATACTTCCCTGATAAGAATATAACATTTCGA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTACTAGTACAGATATGGCTAATAGTACAGAAACTAACAGTACACGA
ATCATCACAATCCACTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAACAATACA
GAGGATACGGAGACATTCAGACCTGAAGGAGGAAATATGAAGGACAATTG
GAGAAGTGAATTATATAAATATAAAGTGGTAGAAGTTAAGCCATTAGGAG
TAGCACCCACTAATGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA
CAGCATATGTTGAAACTCACGGTCTGGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGCTGGAGTAATAAAACTTATGATGATATTTGGGATAACATGACCTGGAT
GCAGTGGGAGAGAGAAATTAGCAATTATACAAACATAATATATGAATTGC
TTGAAGAATCACAAAACCAGCAGGAAAAGAATGAACAAGATTTACTAGCA
TTGGACAGATGGAACAGTCTGTGGAATTGGTTTAACATAACAAATTGGCT
GTGGTATATAAAAATATTCATAATGATAGTAGGAGGCTTGATAGGTTTAA
GAATAATTTTTGCTGTGCTTTCTTTAGTAAATAGAGTTAGGCAGGGATAC
TCACCTCTGTCATTGCAGACCCTTATCCCAAGCCCGAGGGGACCAGACAG Fig. 15 (cont.)
GCCCGGAGGAATCGAAGAAGAAGGTGGAGAGCAAGACAGAAACAGATCAA
CGCGATTAGTGAGCGGATTCTTAGCGCTTGCCTGGGACGACCTGCGGAGC
CTGTGCCTTTTCATCTACCACCGATTGAGAGACTTCATATTAATTGCAGC
GAGAGCGGGGGAACTTCTGGGACGCAGCAGTCTCAAGGGACTACGGAGAG
GGTGGGAAGCCCTTAAGTATCTGGGAAGTCTTGTGCAGTATTGGGGCCTG
GAACTAAAAAGGAGTGCTATTAGTCTATTGGATACCCTAGCAATAGCAGT
AGGTGAGGGAACAGATAGGATTCTAGAATTTGTATTAGGAATTTGTAGAG
CTATCCGCAACATACCTACAAGAATAAGACAGGGCTTTGAAACAGCTTTG
CTATAA
>w136.B8
ATGAGAGTGAGGGGGATACAGAGGAGTTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGGAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTATCAATGCTACTAATGCTA
CTGACAGCAATAGCAATATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGGTGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTAAAAATAT
AACAGACAATAGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAAATATAAGAGA
AGCACATTGTAACATTAGTGAAAGTAAATGGAATGAGACTTTACAAAGGG
TAAGTGAAAAATTAAAAAAATACTTCCCTGATAAGAATATAACATTTCGA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTACTAGTACAGATATGGCTAATAGTACAGAAACTAACAGTACACGA
ATCATCACAATCCACTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAACAATACA
GAGGATACGGAGACATTCAGACCTGAAGGAGGAAATATGAAGGACAATTG
GAGAAGTGAATTATATAAATATAAAGTGGTAGAAGTTAAGCCATTAGGAG
TAGCACCCACTAATGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA
CAGCATATGTTGAAACTCACGGTCTGGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGCTGGAGTAATAAAACTTATGATGATATTTGGGATAACATGACCTGGAT
GCAGTGGGAGAGAGAAATTAGCAATTATACAAACATAATATATGAATTGC
TTGAAGAATCACAAAACCAGCAGGAAAAGAATGAACAAGATTTACTAGCA
TTGGACAGATGGAACAGTCTGTGGAATTGGTTTAATATAACAAATTGGCT
GTGGTATATAAAAATATTCATAATGATAGTAGGAGGCTTGATAGGTTTAA
GAATAATTTTTGCTGTGCTTTCTTTAGTAAATAGAGTTAGGCAGGGATAC
TCACCTCTGTCATTGCAGACCCTTATCCCAAGCCCGAGGGGACCAGACAG
GCCCGGAGGAATCGAAGAAGAAGGTGGAGAGCAAGACAGAAACAGATCAA
CGCGATTAGTGAGCGGATTCTTAGCGCTTGCCTGGGACGACCTGCGGAGC
CTGTGCCTTTTCATCTACCACCGATTGAGAGACTTCATATTAATTGCAGC
GAGAGCGGGGGAACTTCTGGGACGCAGCAGTCTCAAGGGACTACGGAGAG
GGTGGGAAGCCCTTAAGTATCTGGGAAGTCTTGTGCAGTATTGGGGCCTG

Fig. 15 (cont.)
```
GAACTAAAAAGGAGTGCTATTAGTCTATTGGATACCCTAGCAATAGCAGT
AGGTGAGGGAACAGATAGGATTCTAGAATTTGTATTAGGAATTTGTAGAG
CTATCCGCAACATACCTACAAGAATAAGACAGGGCTTTGAAACAGCTTTG
CTATAA
>w136.B36
ATGAGAGTGAGGGGGATACAGAGGAGTTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGGAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTATCAATGCTACTAATGCTA
CTGACAGCAATAGCAATATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGGTGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGGCATTCAATGGAACAGGACCGTGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTAAAAATAT
AACAGACAATAGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAAATATAAGAGA
AGCACATTGTAACATTAGTGAAAGTAAATGGAATGAGACTTTACAAAGGG
TAAGTGAAAAATTAAAAAAATACTTCCCTGATAAGAATATAACATTTCGA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTACTAGTACAGATATGGCTAATAGTACAGAAACTAACAGTACACGA
ATCATCACAATCCATTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAACAATACA
GAGGATACGGAGACATTCAGACCTGAAGGAGGAAATATGAAGGACAATTG
GAGAAGTGAATTATATAAATATAAAGTGGTAGAAGTTAAGCCATTAGGAG
TAGCACCCACTAATGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA
CAGCATATGTTGAAACTCACGGTCTGGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGCTGGAGTAATAAAACTTATGATGATATTTGGGATAACATGACCTGGAT
GCAGTGGGAGAGAGAAATTAGCAATTATACAAACATAATATATGAATTGC
TTGAAGAATCACAAAACCAGCAGGAAAAGAATGAACAAGATTTACTAGCA
TTGGACAGATGGAACAGTCTGTGGAATTGGTTTAACATAACAAATTGGCT
GTGGTATATAAAAATATTCATAATGATAGTAGGAGGCTTGATAGGTTTAA
GAATAATTTTTGCTGTGCTTTCTTTAGTAAATAGAGTTAGGCAGGGATAC
TCACCTCTGTCATTGCAGACCCTTATCCCAAGCCCGAGGGGACCAGACAG
GCCCGGAGGAATCGAAGAAGAAGGTGGAGAGCAAGACAGAAACAGATCAA
CGCGATTAGTGAGCGGATTCTTAGCGCTTGCCTGGGACGACCTGCGGAGC
CTGTGCCTTTTCATCTACCACCGATTGAGAGACTTCATATTAATTGCAGC
GAGAGCGGGGGAACTTCTGGGACGCAGCAGTCTCAAGGGACTACGGAGAG
GGTGGGAAGCCCTTAAGTATCTGGGAAGTCTTGTGCAGTATTGGGGCCTG
GAACTAAAAGGAGTGCTATTAGTCTATTGGATACCCTAGCAATAGCAGT
AGGTGAAGGAACAGATAGGATTCTAGAATTTGTATTAGGAATTTGTAGAG
CTATCCGCAACATACCTACAAGAATAAGACAGGGCTTTGAAACAGCTTTG
TTATAA
>w136.B20
```

Fig. 15 (cont.)
ATGAGAGTGAGGGGGATACAGAGGAGTTATCCACAATGGTGGATATGGAG
CATGTTAGGCTTTTGGATGCTAATGATTTGTAATGGGATGTGGGTCACAG
TCTACTATGGGGTACCTGTGTGGAGAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGGAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTATCAATGCTACTAATGCTA
CTGACAGCAATAGCAATATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGGTGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTAAAAATAT
AACAGATAATAGCAAAACAATAATAGTACATCTCAATGAATCTGTAAAGA
TTGAGTGTACGAGACCCAGTAATAACACAAGCAAGTATAAGAATAGGA
CCAGGACAAGCATTTTATGCAACAGGACAAGTAATAGGAAATATAAGAGA
AGCACATTGTAACATTAGTGAAAGTAAATGGAATGAGACTTTACAAAGGG
TAAGTAAAAAATTAAAAAAATACTTCCCTGATAAGAATATAACATTTCGA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTACTAGTATAGATATGGCTAATAGTACAGAAACTAACAGTACACGA
ATCATCACAATCCACTGCAGAATAAAACAAATTATAAACATGTGGCAGGA
GGTGGGACGAGCAATGTATGCCCCTCCCATTGGGAAACATAACATGTA
TATCAAATATCACAGGACTACTATTGACAAGGGATGGAGGAAACAATACA
GAGGATACGGAGACATTCAGACCTGAAGGAGGAAATATGAAGGACAATTG
GAGAAGTGAATTATATAAATATAAAGTGGTAGAAGTTAAGCCATTAGGAG
TAGCACCCACTAATGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA
CAGCATATGTTGAAACTCACGGTCTGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGCTGGAGTAATAAAACTTATGATGATATTTGGGATAACATGACCTGGAT
GCAGTGGGAGAGAGAAATTAGCAATTATACAAACATAATATATGAATTGC
TTGAAGAATCACAAAACCAGCAGGAAAAGAATGAACAAGATTTACTAGCA
TTGGACAGATGGAACAGTCTGTGGAATTGGTTTAACATAACAAATTGGCT
GTGGTATATAAAAATATTCATAATGATAGTAGGAGGCTTGATAGGTTTAA
GAATAATTTTTGCTGTGCTTTCTTTAGTAAATAAAGTTAGGCAGGGATAC
TCACCTCTGTCATTGCAGACCCTTATCCCAAGCCCGAGGGGACCAGACGA
GCCCGGAGGAATCGAAGAAGAAGGTGGAGAGCAAGACAGAAACAGATCAA
CGCGATTAGTGAGCGGATTCTTAGCGCTTGCCTGGGACGACCTGCGGAGC
CTGTGCCTTTTCATCTACCACCGATTGAGAGACTTCATATTAATTGCAGC
GAGAGCGGGGGAACTTCTGGGACGCAGCAGTCTCAAGGGACTACGGAGAG
GGTGGGAAGCCCTTAAGTATCTGGGAAGTCTTGTGCAGTATTGGGGCCTG
GAACTAAAAAGGAGTGCTATTAGTCTATTGGATACCCTAGCAATAGCAGT
AGGTGAAGGAACAGATAGGATTCTAGAATTTGTATTAGGAATTTGTAGAG
CTATCCGCAACATACCTACAAGAATAAGACAGGGCTTTGAAACAGCTTTG
CTATAA
>w136.B5
ATGAGAGTGATGGGGACACAGAGGAATTATCCACAATGGTGGATATGGAG
CATGTTAGGCTTGTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA Fig. 15 (cont.)
ATGTAACAGAAAATTTCAACATGTGGAAAAATGACATGGCGGATCAGATG
CATGAAGATGTAATTAGTTTATGGGATCAAAGCCTCAAGCCATGTGTAAA
GTTGACCCCACTCTGTGTCACTCTATACTGTATCAATGCTACTGCCAATG
CTACTGTCAGCAATAGCAGTATAATAGAGGAAATGAAAAATTGCTCTTTC
AATATAACCACAGAATTAAGAGATAAGAGAGAGAAAAAGAATGCACTTTT
TTATAAACTTGATATAGTACAACTAGATGGCAACTCTAGTCAGTATAGAT
TAATAAATTGTAATACCTCAGCCATAACACAAGCCTGTCCAAAGGTCTCT
TTTGACCCAATTCCTATACATTATTGTGCTCCAGCTGGTTATGCGATTCT
AAAGTGTAATAATAAGACATTCAATGGAACAGGACCGTGTAATAATGTCA
GCACAGTACAATGTACACATGGAATTAAGCCAGTGGTTTCAACCCAACTA
TTGTTAAATGGTAGCCTAGCAGAAGGAGAGATAATAATTAGATCTGAAAA
TATAACAAACAGTGCCAAAACAATAATAGTACATCTCAATGAATCTGTAA
AGATTGAGTGTACGAGACCCAGTAATAACACAAGAACAAGTATAAGAATA
GGACCAGGACAAGCATTTTATGCAACAGGACAAGTAATAGGAGACATAAG
ACAAGCACATTGTAACATTAGTGAAAGTAAATGGAATGAAACTTTACAAA
GGGTAAGTGAAAAATTAAAAGAATACTTCCCTAATAAGACTATAACATTT
CAACCATCCTCAGGAGGGGACCCAGAAATTACAACACATAGCTTTAATTG
TGGAGGAGAATTTTTCTATTGCAATACATCAAGCCTGTTTAATAGGACAT
ATATGGCTAATAGTACAGATATGGCTAATAGTACAGAAACTAACAGTACA
CGAACCATCACACTCCACTGCAGAATAAAACAAATTATAAACATGTGGCA
AGAGGTGGGACGAGCAATGTATGCCCCTCCCATTGCAGGAAACATAACAT
GTATATCAAATATCACAGACTACTATTGACAGGGATGGAGGAAACAGC
AGTAAGGAGACAGAGACATTCAGACCTGGAGGAGGAAATATGAAGGACAA
TTGGAGAAGTGAATTATATAAATATAAAGTGGTAGAAGTTAAGCCATTAG
GAGTAGCACCCACTAATGCAAGAAGGAGAGTGGTGGAGAGAGAAAAAAGA
GCAGTGGGAATGGGAGCTGTGTTCCTTGGGTTCTTGGGAGCGGCAGGAAG
CACTATGGGCGCAGCATCAATAACGCTGACGGTACAGGCCAGACAATTAT
TGTCTGGTATAGTGCAACAGCAAAGCAATTTGCTGAAGGCTATAGAGGCT
CAACAGCATATGTTGAAACTCACGGTCTGGGGCATTAAACAGCTCCAGGC
AAGAGTCCTGGCCTTGGAAAGATACCTAAAGGATCAACAGCTCCTAGGGA
TGTGGGGCTGCTCTGGAAAACTCATCTGCACCACTAATGTATATTGGAAC
TCTAGTTGGAGTAATAAAACTTATGGTGATATTTGGGATAACATGACCTG
GATGCAGTGGGAGAGAGAAATTAGCAATTATACAGACCTAATATATGACT
TGCTTGAAGAATCACAAAACCAGCAGGAAAAGAATGAACAAGATTTATTA
GCATTGGACAGATGGAACAGTCTGTGGAATTGGTTTAACATAACAAAATG
GCTGTGGTATATAAAAATATTCATAATGATAGTAGGAGGCTTGATAGGTT
TAAGAATAATTTTTGCTGTGCTTTCTTTAGTAATAGAGTTAGGCAGGGA
TACTCACCTCTGTCGTTGCAGACCCTTATCCCAAGCCCGAGGGGACCAGA
CAGGCCCGGAGGAATCGAAGAAGAAGGTGGAGAGCAAGACAGAAACAGAT
CAACGCGATTAGTGAGCGGATTCTTAGCGCTTGCCTGGGACGACCTGCGG
AGCCTGTGCCTTTTCCTCTACCACCGATTGAGAGACTTCATATTAATTGC
AGCGAGAGCGGGGGAACTTCTGGGACGCAGCAGTCTCAAGGGACTACGGA
GAGGGTGGGAAGCCCTTAAGTATCTGGGAGGTCTTGTGCAGTATTGGGGC
CTGGAACTAAAAAGGAGTGCTATTAGTCTATTGGATACCCTAGCAATAGC
AGTAGGTGAAGGAACAGATAGGATTCTAGAATTTGTATTAGGAATTTGTA
GAGCTATCCGCAACATACCTACAAGAATAAGACAGGGCTTTGAAACAGCT
TTGCTATAA
>w136.B2
ATGAGAGTGAGGGGGATACAGAGGAATTATCCACAATGGTGGATATGGAG
CATGTTAGGCTTGTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGCGCATAATGTCTGGGCTAC
ACATGCCTGTGTACCCACAGACCCCAATCCACAAGAAATGGTTTTAAAAA
ATGTAACAGAAAATTTCAACATGTGGAAAATGACATGGTAGATCAGATG
CATGAAGATGTAATTAGTTTATGGGATCAAAGCCTCAAGCCATGTGTAAA
GTTGACCCCACTCTGTGTCACTCTAAACTGTACCGATGCTAATGCTACTG
CCAGCAATACCAATGCTACTGTCAGCAATATCAAGGCTACTGTCAGCAAT
AGCAGTATAATAGAGGAAATGAAAAATTGCTCTTTCAATATAACCACAGA Fig. 15 (cont.)
ATTAAGAGATAAGATAGAGAAAAAGTATGCACTTTTTTATAAACTTGATA
TAGTACAACTAGATGGCAACTCTACTCAGTATAGATTCATAAATTGTAAT
ACCTCAGCCATAACACAAGCCTGTCCAAAGGTCTCTTTTGACCCAATTCC
TATACATTATTGTGCTCCAGCTGGTTATGCGATTCTAAAGTGTAATAATA
AGACATTCAATGGAACAGGACCGTGTAATAATGTCAGCACAGTACAATGT
ACACATGGAATTAAGCCAGTGGTTTCAACTCAACTATTGTTAAATGGTAG
CCTAGCAGAAGGAGAGATAATAATTAGATCTGAAAATATAACAGACAATG
GCAAAACAATAATAGTACATCTCAATGAATCTGTAAAGATTGAGTGTACG
AGACCCGGCAATAACACAAGAACAAGTATAAGAATAGGACCAGGACAAGC
ATTTTATGCAACAGGACAAGTAATAGGAGACATAAGACAAGCACATTGTA
ACATTAGTGAAAGTAAATGGAATGAAACTTTACAAAGGGTAAGTGAAAAA
TTAAAAGAATACTTCCCTAATAAGACTATAACATTTCAACCATCCTCAGG
AGGGGACCCAGAAATTACAACACATAGCTTTAATTGTGGAGGAGAATTTT
TTTATTGCAATACATCAAGCCTGTTTAATAGGACATACATGGCTAATAGT
ACAGAAACTAACAGTACACGAACCATCACACTCCACTGCAGAATAAAACA
AATTATAAACATGTGGCAGGAGGTGGGACGAGCAATGTATGCCCCTCCCA
TTGCAGGAAACATAACATGTATATCAAATATCACAGGACTACTATTGACA
AGGGATGGAGGAAACACTACGGATATAGAGACATTCAGACCTGGAGGAGG
AAATATGAAGGACAATTGGAGAAGTGAATTATATAAATATAAAGTGGTAG
AAGTTAAGCCATTAGGAGTAGCACCCACTAAGGCAAGAAGGAGAGTGGTG
GAGAGAGAAAAAAGAGCAGTGGGAATGGGAGCTGTGTTCCTTGGGTTCTT
GGGAGCGGCAGGAAGCACTATGGGCGCAGCATCGATAACGCTGACGGTAC
AGGCCAGACAATTATTGTCTGGTATAGTGCAACAGCAAAGCAATTTGCTG
AAGGCTATAGAGGCTCAACAGCATATGTTGAAACTCACGGTCTGGGGCAT
TAAACAGCTCCAGGCAAGAGTCCTGGCCTTGGAAAGATACCTAAAGGATC
AACAGCTCCTAGGGATGTGGGCTGCTCTGGAAAACTCATCTGCACCACT
AATGTATATTGGAACTCTAGTTGGAGTAATAAAACTTATGATGATATTTG
GGATAACATGACCTGGATGCAGTGGGAGAGAGAAATTAGCAATTACACAG
AAATAATATATGACTTGCTTGAAGAATCACAAAACCAGCAGGAAAAGAAT
GAACAAGATTTACTAGCATTGGACAGGTGGAACAGTCTGTGGAATTGGTT
TAACATAACAAAATGGCTGTGGTATATAAAAATATTCATAATGATAGTAG
GAGGCTTGATAGGTTTAAGAATAATTTTTGCTGTGCTTTCTTTAGTAAAT
AGAGTTAGGCAGGGATACTCACCTCTGTCGTTGCAGACCCTTATCCCAAG
CCCGAGGGGACCAGACAGGCCCGGAGGAATCGAAGAAGAAGGTGGAGAGC
AAGACAGAAACAGATCAACGCGATTAGTGAGCGGATTCTTAGCGCTTGCC
TGGGACGACCTGCGGAGCCTGTGCCTTTTCATCTACCACCGATTGAGAGA
CTTCATATTAATTGCAGCGAGAGCGGGGGAACTTCTGGGACGCAGCAGTC
TCAAGGGACTACGGAGAGGGTGGGAAGCCCTTAAGTATCTGGGAGGTATT
GTGCAGTATTGGGGCCTGGAACTAAAAAGGAGTGCTATTAGTCTATTGGA
TACCCTAGCAATAGCAGTAGGTGAAGGAACAGATAGGATTCTAGAATTTG
TATTAGGAATTTGTAGAGCTATCCGCAACATACCTACAAGAATAAGACAG
GGCTTTGAAACAGCTTTGCTATAA
>w136.B3
ATGAGAGTGAGGGGGATACAGAGGAATTATCCACAATGGTGGATATGGAG
CATGTTAGGCTTGTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGCGCATAATGTCTGGGCTAC
ACATGCCTGTGTACCCACAGACCCCAATCCACAAGAAATGGTTTTAAAAA
ATGTAACAGAAAATTTCAACATGTGGGAAAATGACATGGTAGATCAGATG
CATGAAGATGTAATTAGTTTATGGGATCAAAGCCTCAAGCCATGTGTAAA
GTTGACCCCACTCTGTGTCACTCTAAACTGTACCGATGCTAATGCTACTG
CCAGCAATGCTAATGCTACTGCCAGCAATACCAATGCTACTGTCAGCAAT
GATAGCAGTATAATAGAGGAAATGAAAAATTGCTCTTTCAATATAACCAC
AGAATTAAGAGATAAGATAGAGAAAAAGTATGCACTTTTTTATAAACTTG
ATATAGTACAACTAGATGGCAACTCTACTCAGTATAGATTCATAAATTGT
AATACCTCAGCCATAACACAAGCCTGTCCAAAGGTCTCTTTTGACCCAAT
TCCTATACATTATTGTGCTCCAGCTGGTTATGCGATTCTAAAGTGTAATA
ATAAGACATTCAATGGAACAGGACCGTGTAATAATGTCAGCACAGTACAA Fig. 15 (cont.)
```
TGTACACATGGAATTAAGCCAGTGGTTTCAACTCAACTATTGTTAAATGG
TAGCCTAGCAGAAGGAGAGATAATAATTAGATCTAAAAACATAACAGACA
ATGGCAACACAATAATAGTACATCTCAATGAATCTGTAAAGATTGAGTGT
ACGAGACCCAGTAATAACACAAGAACAAGTATAAGAATAGGACCAGGACA
AGCATTTTATGCAACAGGACAAGTAATAGGAGACATAAGACAAGCACATT
GTAACATTAGTGAAAGTAAATGGAATGAAACTTTACAAAGGGTAAGTGAA
AAATTAAAAGAATACTTCCCTGATAAGAATATAACATTTCAACCATCCTC
AGGAGGGGACCCAGAAATTACAACACATAGCTTTAATTGTGGAGGAGAAT
TTTTTTATTGCAATACATCAAGCCTGTTTAATAGGACATACATGGCTAAT
AGTACAGAAACTAACAGTACACGAACCATCACACTCCACTGCAGAATAAA
ACAAATTATAAACATGTGGCAAGAGGTGGGACGAGCAATGTATGCCCCTC
CCATTGCAGGAAACATAACATGTATATCAAATATCACAGGACTACTATTG
ACAAGGGATGGAGGAAACAGCAGTAAGGAGACAGAGACATTCAGACCTGG
AGGAGGAAATATGAAGGACAATTGGAGAAGTGAATTATATAAATATAAAG
TGGTAGAAGTTAAGCCATTAGGAGTAGCACCCACTAATGCAAGAAGGAGA
GTGGTGGAGAGAGAAAAAGAGCAGTGGGAATGGGAGCTGTGTTCCTTGG
GTTCTTGGGAGCGGCAGGAAGCACTATGGGCGCAGCATCAATAACGCTGA
CGGTACAGGCCAGACAATTATTGTCTGGTATAGTGCAACAGCAAAGCAAT
TTGCTGAAGGCTATAGAGGCTCAACAGCATATGTTGAGACTCACGGTCTG
GGGCATTAAACAGCTCCAGGCAAGAGTCCTGGCCTTGGAAAGATACCTAA
AGGATCAACAGCTCCTAGGGATGTGGGGCTGCTCTGGAAAACTCATCTGC
ACCACTAATGTATATTGGAACTCTAGTTGGAGTAATAAAACTTATAGTGA
TATTTGGGATAACATGACCTGGATGCAGTGGGAGGGAGAAATTAGCAATT
ATACAGAAATAATATATAACTTGCTTGAAGAATCACAAAACCAGCAGGAA
AAGAATGAACAAGATTTACTAGCATTGGACAGATGGAACAGTCTGTGGAA
TTGGTTTAACATAACAAAGTGGCTGTGGTATATAAAAATATTCATAATGA
TAGTAGGAGGCTTGATAGGTTTAAGAATAATTTTTGCTGTGCTTTCTTTA
GTAAATAGAGTTAGGCAGGGATACTCACCTCTGTCGTTGCAGACCCTTAT
CCCAAGCCCGAGGGGACCAGACAGGCCCGGAGGAATCGAAGAAGAAGGTG
GAGAGCAAGACAGAAAGAGATCAACGCGATTAGTGAGCGGATTCTTAGCG
CTTGTCTGGGACGACCTGCGGAGCCTGTGCCTTTTCCTCTACCACCGATT
GAGAGACTTCATATTAATTGCAGCGAGAGCGGGGGAACTTCTGGGACGCA
GCAGTCTCAAGGGACTACGGAGAGGGTGGGAAGCCCTTAAGTATCTGGGA
AGTCTTGTGCAGTATTGGGGCCTGGAACTAAAAGGGAGTGCTATTAGTCT
ATTGGATACCCTAGCAATAGCAGTAGGTGAAGGAACAGATAGGATTCTAG
AATTTGTATTAGGAATTTGTAGAGCTATCCGCAACATACCCACAAGAATA
AGACAGGGCTTTGAAACAGCTTTGCTATAA
>w136.B18
ATGAGAGTGATGGGGAGACAGAGGAATTATCCACAATGGTGGATATGGAG
CATGTTAGGCTTGTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCACGCCATGTGTAAA
GTTGACCCCACTCTGTGTCACTCTAAACTGTACCGATGCTAATGATACTG
CCAGCAATAGCAGTATAATAAAGGGAATGAATAACAGTATAGTAGGGGAA
ATGAAAAATTGCTCTTTCAATATAACCACAGAATTAAGAGATAAGAGAGA
GAAAAGAATGCACTTTTTTTATAAACTTGATATAGTACAACTAGATGGCA
ACTCTAGTGAGTATAGATTAATAAATTGTAATACCTCAGTCATAACACAA
GCCTGTCCAAAGGTCTCTTTTGACCCAATTCCTATACATTATTGTGCTCC
AGCTGGTTATGCGATTCTAAAGTGTAATAATAAGACATTCAATGGAACAG
GACCGTGTAATAATGTCAGCACAGTACAATGTACACATGGAATTAAGCCA
GTGGTTTCAACTCAACTATTGTTAAATGGTAGCAGAAGGAGAT
AATAATTAGATCTGAAAATATAACAGACAATGCCAAAACAATAATAGTAC
ATCTCAATGAATCTGTAAAGATTGAGTGTACGAGACCCAGTAATAACACA
AGAACAAGTATAAGAATAGGACCAGGACAAGCATTTTATGCAACAGGACA
AGTAATAGGAGACATAAGAAAAGCACATTGTAACATTAGTGAAAGTAAAT
```

Fig. 15 (cont.)
GGAATGAAACTTTACAAAGGGTAAGTAAAAAATTAAAAGAATACTTCCCT
GATAAGAATATAACATTTCAACCATCCTCAGGAGGGGACCCAGAAATTAC
AACACATAGCTTTAATTGTGGAGGAGAATTTTTCTATTGCAATACATCAA
GCCTGTTTAATAGGACATATATGGCTAATAGTACAGATATGGCTAATAGT
GCAGAAACTAACAGTACAAGAACCATCACACTCCACTGCAGAATAAAACA
AATTATAAACATGTGGCAGGAGGTGGGACGAGCAATGTATGCCCCTCCCA
TTGCAGGAAACATAACATGTATATCAAATATCACAGGACTACTATTGACA
AGGGATGGAGGAAACAGCAGTACGGAGACAGAGACATTCAGACCTGGAGG
AGGAAATATGAAGGACAATTGGAGAAGTGAATTATATAAATATAAAGTGG
TAGAAGTTAAGCCATTAGGAGTAGCACCCACTAATGCAAGAAGGAGAGTG
GTGGAGAGAGAAAAAGAGCAGTGGGAATGGGAGCTGTGTTCCTTGGGTT
CTTGGGAGCGGCAGGAAGCACTATGGGCGCAGCATCAATAACGCTGACGG
TACAGGCCAGACAATTATTGTCTGGCATAGTGCAACAGCAAAGCAATTTG
CTGAAGGCTATAGAGGCTCAACAGCATATGTTGAGACTCACGGTCTGGGG
CATTAAACAGCTCCAGGCAAGAGTCCTGGCCTTGGAAAGATACCTAAAGG
ATCAACAGCTCCTAGGGATGTGGGCTGCTCTGGAAAACTCATCTGCACC
ACTAATGTATATTGGAACTCTAGTTGGAGTAATAAAACTTATGATGATAT
TTGGGATAACATGACCTGGATGCAGTGGGAGGGAGAAATTAGCAATTATA
CAAACATAATATATGACTTGCTTGAAGAATCACAAAACCAGCAGGAAAAG
AATGAACAAGATTTACTAGCATTGGACAGATGGAACAGTCTGTGGAATTG
GTTTAACATAACAAATTGGCTGTGGTATATAAAAATATTCATAATGATAG
TAGGAGGCTTGATAGGTTTAAGAATAATTTTTGCTGTGCTTTCTTTAGTA
AATAGAGTTAGGCAGGGATACTCACCTCTGTCGTTGCAGACCCTTATCCC
AAGCCCGAGGGGACCAGACAGGCCCGGAGGAATCGAAGAAGAAGGTGGAG
AGCAAGACAGAAAGAGATCAACGCGATTAGTGAGCGGATTCTTAGCGCTT
GTCTGGGACGACCTGCGGAGCCTGTGCCTTTTCCTCTACCACCGATTGAG
AGACTTCATATTAATTGCAGCGAGAGCGGGGGAACTTCTGGGACGCAGCA
GTCTCAAGGGACTACGGAGAGGGTGGGAAGCCCTTAAGTATCTGGGAAGT
CTTGTGCAGTATTGGGGCCTGGAACTAAAAAGGAGTGCTATTAGTCTATT
GGATACCCTAGCAATAGCAGTAGGTGAAGGAACAGATAGGATTCTAGAAT
TTGTATTAGGAATTTGTAGAGCTATCCGCAACATACCTACAAGAATAAGA
CAGGGCTTTGAAACAGCTTTGCTATAA
>w160.A1
ATGAGAGTGAGGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGGAAATGACATGGTGGATACAGATG
CATGAAGATGTAATTAGTTTATGGGATCAAAGCCTCAAGCCATGTGTAAA
GTTGACCCCACTCTGTGTCACTCTAAACTGTATCAATGCTACTAATGCTA
CTGACAGCAAAAGCAATATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGGTGGCAACTCTAACTCTAGTCAGTATA
GATTAATAAATTGTAATACCTCAGTCATAACACAAGCCTGTCCAAAGGTC
TCTTTTGACCCAATTCCTATACATTATTGTGCTCCAGCTGGTTATGCGAT
TCTAAAGTGTAATAATAAGACATTCAATGGAACAGGACCGTGTAATAATG
TCAGCACAGTACAATGTACTCATGGAATTAAGCCAGTGGTTTCAACTCAA
CTATTGTTAAATGGTAGCCTAGCAGAAGGAGAGATAATAATTAGATCTAA
AAATATAACAGACAATAGCAAAACAATAATAGTACATCTCAATGAATCTG
TAAAGATTGAGTGTACGAGACCCAGTAATAACACAAGAACAAGTATAAGA
ATAGGACCAGGACAAGCATTTTATGCAACAGGACAAGTAATAGGAAATAT
AAGAGAAGCACATTGTAACATTAGTGAAAGTAAATGGAATGAAACTTTAC
AAAGGGTAAGTGAAAAATTAAAAGAATACTTCCCTCAAAAGAATATAACC
TTTCAACCATCCTCAGGAGGGGACCTAGAAATTACAACACATAGCTTTAA
TTGTGGAGGAGAATTTTTCTATTGCAATACATCAAGCCTGTTTAATAGGA
CATATATGGCTACTGGTACAGATATGGCTAATAGTACAGAAACTAACATC
ATCACAATCCACTGCAGAATAAAACAAATTATAAACATGTGGCAGGAGGT Fig. 15 (cont.)
GGGACGAGCAATGTATGCCCCTCCCATTGCAGGAAACATAACATGTATAT
CAAATATCACAGGACTACTATTGACAAGGGATGGAGGAAACAGTACAGAG
GATACGGAGACATTCAGACCTGTAGGAGGAAATATGAAGGACAATTGGAG
CAGTGAATTATATAAATATAAAGTGGTAGAAGTTAAGCCATTAGGAGTAG
CACCCACTAATGCAAGAAGGAGAGTGGTGGAGAGAGAAAAAAGAGCAGTG
GGAATGGGAGCTGTGTTCCTTGGGTTCTTGGGAGCGGCAGGAAGCACTAT
GGGCGCAGCATCAATAACGCTGACGGTACAGGCCAGACAATTATTGTCTG
GTATAGTGCAACAGCAAAGCAATTTGCTGAAGGCTATAGAGGCTCAACAG
CATATGTTGAAACTCACGGTCTGGGGCATTAAACAGCTCCAGGCAAGAGT
CCTGGCCTTGGAAAGATACCTAAAGGATCAACAGCTCCTAGGGATGTGGG
GCTGCTCTGGAAAACTCATCTGCACCACTAATGTATATTGGAACTCTAGC
TGGAGTAATAAAACTTATGATGATATTTGGGATAACATGACCTGGATGCA
GTGGGAGAGAGAAATTAGCAATTATACAAACATAATATATGAATTGCTTG
AAGAATCACAAAACCAGCAGGAAAAGAATGAACAAGATTTACTAGCATTG
GACAGATGGAACAGTCTGTGGAATTGGTTTAACATAACAAATTGGCTGTG
GTATATAAAAATATTCATAATGATAGTAGGAGGCTTGATAGGTTTAAGAA
TAATTTTTGCTGTGCTTTCTTTAGTAAATAGAGTTAGGCAGGGATACTCA
CCTCTGTCATTGCAGACCCTTATCCCAAGCCCGAGGGGACCAGACAGGCC
CGGAGGAATCGAAGAAGAAGGTGGAGAGCAAGACAGAAACAGATCAACGC
GATTAGTGAGCGGATTCTTAGCGCTTGCCTGGGACGACCTGCGGAGCCTG
TGCCTTTTCATCTACCACCGATTGAGAGACTTCATATTAATTGCAGCGAG
AGCGGGGGAACTTCTGGGACGCAGCAGTCTCAAGGGACTACGGAGAGGGT
GGGAAGCCCTTAAGTATCTGGGAAGTCTTGTGCAGTATTGGGGCCTGGAA
CTAAAAAGGAGTGCTATTAGTCTATTGGATACCCTAGCAATAGCAGTAGG
TGAAGGAACAGATAGGATTCTAGAATTTGTATTAGGAATTTGTAGAGCTA
TCCGCAACATACCTACAAGAATAAGACAGGGCTTTGAAACAGCTTTGCTG
TAA
>w160.c11
ATGAGAGTGAGGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGGAAAATGACATGGTGGATCAGATG
CATGAAGATGTAATTAGTTTATGGGATCAAAGCCTCAAGCCATGTGTAAG
GTTGACCCCACTCTGTGTCACTCTAAACTGTATCAATGCTACTAATGCTA
CTGCCAGCGATAGCAGTATATTAGATGGAATGAAAAATTGCTCTTTCAAT
ATAACCACAGAATTAAGAGATAAGAGAGAGAAAAAGAATGCACTTTTTTA
TAAACTTGATATAGTACAACTAGGTGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTAAAAATAT
AACAGACAATAGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAAATATAAGAGA
AGCACATTGTAACATTAGTGAAAGTAAATGGAATGAGACTTTACAAAGGG
TAAGTGAAAAATTAAAAAAATACTTCCCTGATAAGAATATAACATTTCAA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTACTAGTACAGATTTGGCTAATAGTACAGAAACTAACATCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAACAATACAGAGGATACG
GAGACATTCAGACCTGTAGGAGGAAATATGAAGGACAATTGGAGCAGTGA
ATTATATAAATATAAAGTGGTAGAAGTTAAGCCATTAGGAGTAGCACCCA
CTAATGCAAGAAGGAGAGTGGTGAAGAGAGAAAAAAGAGCAGTGGGAATG Fig. 15 (cont.)
GGAGCTATGTTCCTTGGGTTCTTGGGAGCGGCAGGAAGCACTATGGGCGC
AGCATCAATAACGCTGACGGTACAGGCCAGACAATTATTGTCTGGTATAG
TGCAACAGCAAAGCAATTTGCTGAAGGCTATAGAGGCTCAACAGCATATG
TTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCT
CTGGAAAACTCATCTGCACCACTAATGTATATTGGAACTCTAGCTGGAGT
AATAAAACTTATGATGATATTTGGGATAACATGACCTGGATGCAGTGGGA
GAGAGAAATTAGCAATTATACAGAACTAATATATGAATTGCTTGAAGAAT
CACAAAACCAGCAGGAAAAGAATGAACAAGATTTACTAGCATTGGACAGA
TGGAACAGTCTGTGGAATTGGTTTAACATAACAAATTGGCTGTGGTATAT
AAAAATATTCATAATGATAGTAGGAGGCTTGATAGGTTTAAGAATAATTT
TTGCTGTGCTTTCTTTAGTAAATAGAGTTAGGCAGGGATACTCACCTCTG
TCATTGCAGACCCTTATCCCAAGCCCGAGGGGACCAGACAGGCCCGGAGG
AATCGAAGAAGAAGGTGGAGAGCAAGACAGAAACAGATCAACGCGATTAG
TGAGCGGATTCTTAGCGCTTGCCTGGGACGACCTGCGGAGCCTGTGCCTT
TTCATCTACCACCGATTGAGAGACTTCATATTAATTGCAGCGAGAGCGGG
GGAACTTCTGGGACGCAGCAGTCTCAAGGGACTACGGAGAGGGTGGGAAG
CCCTTAAGTATCTGGGAAGTCTTGTGCAGTATTGGGGCCTGGAACTAAAA
AGGAGTGCTATTAGTCTATTGGATACCCTAGCAATAGCAGTAGGTGAGGG
AACAGATAGGATTCTAGAATTTGTATTAGGAATTTGTAGAGCTATCCGCA
ACATACCTACAAGAATAAGACAGGGCTTTGAAACAGCTTTGCTATAA
>w160.C12
ATGAGAGTGATGGGGAGACAGAGGAATTATCCACAATGGTGGATATGGAG
CATGTTAGGCTTGTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGGATATGAGAAGGAAGTGCATAATGTCTGGGCTAC
ACATGCCTGTGTACCCACAGACCCCAATCCACAAGAAATGGTTTTAAAAA
ATGTAACAGAAAATTTCAACATGTGGGAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCGATGCTAATGCTACTG
CCAGCAATGCTAATGCTACTGTCAGCAATACCAATGCTACTGTCAGCAAT
GATAGCAGTATAATAGAGGAAATGAAAAATTGCTCTTTCAATATAACCAC
AGAATTAAGAGATAAGATAGAGAAAAAGTATGCACTTTTTTATAAACTTG
ATATAGTACAACTAGATGGCAACTCTACTCATTATAGATTCATAAATTGT
AATACCTCAGCCATAACACAAGCCTGTCCAAAGGTCTCTTTTGACCCAAT
TCCTATACATTATTGTGCTCCAGCTGGTTATGCGATTCTAAAGTGTAATA
ATAAGACATTCAATGGAACAGGACCGTGTAATGTCAGCACAGTACAA
TGTACACATGGAATTAAGCCAGTGGTTTCAACTCAACTATTGTTAAATGG
TAGCCTAGCAGAAGGAGAGATAATAATTAGATCTAAAAATATAACAGACA
ATGGCAAAACAATAATAGTACATCTCAATGAATCTGTAAAGATTGAGTGT
ACGAGACCCAGTAATAACACAAGAACAAGTATAGGAATAGGACCAGGACA
AGCATTTTATGCAACAGGACAAGTAATAGGAGACATAAGAAAAGCACATT
GTAACATTAGTGAAAGTAAATGGAATGAAACTTTACAAAGGGTAAGTAAA
AAATTAAAAGAATACTTCCCTGGTAAGAATATAACATTTCAACCATCCTC
AGGAGGGGACCCAGAAGTTACAACACATAGCTTTAATTGTGGAGGAGAAT
TTTTCTATTGCAATACATCAAGCCTGTTTAATAGAACATATATGACTAAT
AGTACAGATATGGCTAATAGTACAGAAACTAACAGAACCATCACAATCCA
CTGCAGAATAAAACAAATTATAAACATGTGGCAGGAGGTGGGACGAGCAA
TGTATGCCCCTCCCATTGCAGGAAACATAACATGTATATCAAATATCACA
GGACTACTATTGACAAGGGATGGAGGAAACAGCAGTACGGAGACAGAGAC
ATTCAGACCTGAAGGAGGAAATATGAAGGACAATTGGAGAAGTGAATTAT
ATAAATATAAAGTGGTAGAAGTTAAGCCATTAGGAGTAGCACCCACTAAT
GCAAGAAGGAGAGTGGTGGAGAGAAAAAAAGCAGTGGGAATGGGAGC
TGTGTTCCTTGGGTTCTTGGGAGCGGCAGGAAGCACTATGGGCGCAGCAT
CAATAACGCTGACGGTACAGGCCAGACAATTATTGTCTGGCATAGTGCAA
CAGCAAAGCAATTTGCTGAAGGCTATAGAGGCTCAACAGCATATGTTGAG
ACTCACGGTCTGGGGCATTAAACAGCTCCAAGCAAGAGTCCTGGCCTTGG
AAAGATACCTAAAGGATCAACAGCTCCTAGGGATGTGGGGCTGCTCTGGA Fig. 15 (cont.)
AAACTCATCTGCACCACTAATGTATATTGGAACTCTAGTTGGAGTAATAA
AACTTATGATGATATTTGGGATAACATGACCTGGATGCAGTGGGAGGGAG
AAATTAGCAATTATACAAACATAATATATGACTTGCTTGAAGAATCACAA
AACCAGCAGGAAAAGAATGAACAAGATTTACTAGCATTGGACAGATGGAA
CAGTCTGTGGAATTGGTTTAACATAACAAAGTGGCTGTGGTATATAAAAA
TATTCATAATGATAGTAGGAGGCTTGATAGGTTTAAGAATAATTTTTGCT
GTGCTTTCTTTAGTAAATAGAGTTAGGCAGGGATACTCACCTCTGTCGTT
GCAGACCCTTATCCCAAGCCCGAGGGGACCAGACAGGCCCGGAGGAATCG
AAGAAGAAGGTGGAGAGCAAGACAGAAAGAGATCAACGCGATTAGTGAGC
GGATTCTTAGCGCTTGTCTGGGACGACCTGCGGAGCCTGTGCCTTTTCCT
CTACCACCGATTGAGAGACTTCATATTAATTGCAGCGAGAGCGGGGGAAC
TTCTGGGACGCAGCAGTCTCAAGGGACTACGAAGAGGGTGGGAAGCCCTT
AAGTATCTGGGAAGTCTTGTGCAGTATTGGGGCCTGGAACTAAAAGGGAG
TGCTATTAGTCTATTGGATACCCTAGCAATAGCAGTAGGTGAAGGAACAG
ATAGGATTCTAGAATTTGTATTAGGAATTTGTAGAGCTATCCGCAACATA
CCCACAAGAATAAGACAGGGCTTTGAAACAGCTTTGCTATAA
>w160.C14
ATGAGAGTGAGGGGGATACAGAGGAGTTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTTAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTATCAATGCTACTAATGCTA
CTGACAGCAAAAGCAATATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGGTAGCAACTCTAGTCAGTATAGATTAA
TAAATTGTAATACCTCAGTCATAACACAAGCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTTAGCA
CAGTACAATGTACACATGGAATTAAGCCAGTGGTTTCAACTCAACTATTG
TTAAATGGTAGCCTAGCAGAAGGAGAGATAATAATTAGATCTAAAAATAT
AACAGACAATAGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAAATATAAGAGA
AGCACATTGTAACATTAGTGAAAGTAAATGGAATGAAACTTTACAAAGGG
TAAGTGAAAAATTAAAAGAATACTTCCCTGATAAGAATATAACATTTCAA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTAATAGTACAGATATGGCTAATAGTACAGAAACTAACAGTACACAA
ATCATCACAATCCACTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAACAATACA
GAGGATACGGAGACATTCAGACCTGTAGGAGGAAATATGAAGGACAATTG
GAGCAGTGAATTATATAAATATAAAGTGGTAGAAGTTAAGCCATTAGGAG
TAGCACCCACTAATGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA
CAGCATATGTTGAAACTCACGGTCTGGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGCTGGAGTAATAAACTTATGATGATATTTGGATAACATGACCTGGAT
GCAGTGGGAGAGAGAAATTAGCAATTATACAAACATAATATATGAATTGC
TTGAAGAATCACAAAACCAGCAGGAAAAGAATGAACAAGATTTACTAGCA
TTGGACAGATGGAACAGTCTGTGGAATTGGTTTAACATAACAAATTGGCT
GTGGTATATAAAAATATTCATAATGATAGTAGGAGGCTTGATAGGTTTAA

Fig. 15 (cont.)
GAATAATTTTTGCTGTGCTTTCTTTAGTAAATAGAGTTAGGCAGGGATAC
TCACCTCTGTCATTGCAGACCCTTATCCCAAGCCCGAGGGGACCAGACAG
GCCCGGAGGAATCGAAGAAGAAGGTGGAGAGCAAGACAGAAACAGATCAA
CGCGATTAGTGAGCGGATTCTTAGCGCTTGCCTGGGACGACCTGCGGAGC
CTGTGCCTTTTCATCTACCACCGATTGAGAGACTTCATATTAATTGCAGC
GAGAGCGGGGGAACTTCTGGGACGCAGCAGTCTCAAGGGACTACGGAGAG
GGTGGGAAGCCCTTAAGTATCTGGGAAGTCTTGTACAGTATTGGGGCCTG
GAACTAAAAAGGAGTGCTATTAGTCTATTGGATACCCTAGCAATAGCAGT
AGGTGAGGGAACAGATAGGATTCTAGAATTTGTATTAGGAATTTGTAGAG
CTATCCGCAACATACCTACAAGAATAAGACAGGGCTTTGAAACAGCTTTG
CTATAA
>w160.C2
ATGAGAGTGAGGGGGATACAGAGGAGTTATCCACAATGGTGGATATGGAG
CATGTTAGGCTTTTGGATGCTAATGATTTGTAATGGGATGTGGGTCACAG
TCTACTATGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGGAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTATCAATGCTACTAATGCTA
CTGCCAGCGATAGCAGTATATTAGATGGAATGAAAAATTGCTCTTTCAAT
ATAACCACAGAATTAAGAGATAAGAGAGGAAAAAGAATGCACTTTTTTA
TAAACTTGATATAGTACAACTAGGTAGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTAAAAATAT
AACAGACAATAGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAAATATAAGAGA
AGCACATTGTAACATTAGTGAAAGTAAATGGAATGAAACTTTACAAAGGG
TAAGTGAAAAATTAAAAGAATACTTCCCTGATAAGAAAATAACATTTCAA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTAATAGTACAGATATGGCTAATAGTACAGAAACTAACAGTACACAA
ATCATCACAATCCACTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAACAATACA
GAGGATACGGAGACATTCAGACCTGTAGGAGGAAATATGAAGGACAATTG
GAGCAGTGAATTATATAAATATAAAGTGGTAGAAGTTAAGCCATTAGGAG
TAGCACCCACTAATGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA
CAGCATATGTTGAAACTCACGGTCTGGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTACTGTATATTGGAACTCT
AGTTGGAGTAATAAAACTTATGATGATATTTGGGATAACATGACCTGGAT
GCAATGGGAGAGAGAAATTAGCAATTATACAGAAATAATATATGAATTGC
TTGAAGAATCACAAAACCAGCAGGAAAAGAATGAACAAGATTTACTAGCA
TTGGACAGATGGAACAGTCTGTGGAATTGGTTTAACATAACAAATTGGCT
GTGGTATATAAAAATATTCATAATGATAGTAGGAGGCTTGATAGGTTTAA
GAATAATTTTTGCTGTGCTTTCTTTAGTAAATAGAGTTAGGCAGGGATAC
TCACCTCTGTCATTGCAGACCCTTATCCCAAGCCCGAGGGGACCAGACAG
GCCCGGAGGAATCGAAGAAGAAGGTGGAGAGCAAGACAGAAACAGATCAA
CGCGATTAGTGAGCGGATTCTTAGCGCTTGCCTGGGACGACCTGCGGAGC
CTGTGCCTTTTCATCTACCACCGATTGAGAGACTTCATATTAATTGCAGC Fig. 15 (cont.)
GAGAGCGGGGGAACTTCTGGGACGCAGCAGTCTCAAGGGACTACGGAGAG
GGTGGGAAGCCCTTAAGTATCTGGGAAGTCTTGTACAGTATTGGGGCCTG
GAACTAAAAAGGAGTGCTATTAGTCTATTGGATACCCTAGCAATAGCAGT
AGGTGAGGGAACAGATAGGATTCTAGAATTTGTATTAGGAATTTGTAGAG
CTATCCGCAACATACCTACAAGAATAAGACAGGGCTTTGAAACAGCTTTG
CTATAA
>w160.C4
ATGAGAGTGAGGGGGATACAGAGGAGTTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTTAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTATCAATGCTACTAATGCTA
CTGACAGCAAAAGCAATATATTAGAGGGAATGAAAAATTGCTCTTTCAAT
ATAACCACAGAATTAAGAGATAAGAGAGAGAAAAAGAATGCACTTTTTTA
TAAACTTGATATAGTACAACTAGGTGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCATGTAATAATGTCAGCA
CAGTACAATGTACACATGGAATTAAGCCAGTGGTTTCAACTCAACTATTG
TTAAATGGTAGCCTAGCAGAAGGAGAGATAATAGTACATCTCAATGAATCTGTAAAGA
AACAGACAATAGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAAATATAAGAGA
AGCACATTGTAACATTAGTGAAAGTAAATGGAATGAAACTTTACAAAGGG
TAAGTGAAAAATTAAAAGAATACTTCCCTGATAAGAATATAACATTTCAA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTAATAGTACAGATATGGCTAATAGTACAAGTAACAGTACACAA
ATCATCACAATCCACTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAACAATACA
GAGGATACGGAGACATTCAGACCTGTAGGAGGAAATATGAAGGACAATTG
GAGCAGTGAATTATATAAATATAAAGTGGTAGAAGTTAAGCCATTAGGAG
TAGCACCCACTAAGGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA
CAGCATATGTTGAAACTCACGGTCTGGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGCTGGAGTAATAAAACTTATGATGATATTTGGGATAACATGACCTGGAT
GCAGTGGGAGAGAGAAATTAGCAATTATACAAACATAATATATGAATTGC
TTGAAGAATCACAAAACCAGCAGGAAAAGAATGAACAAGATTTACTAGCA
TTGGACAGATGGAACGCTCTGTGGAATTGGTTTAACATAACAAATTGGCT
GTGGTATATAAAAATATTCATAATGATAGTAGGAGGCTTGATAGGTTTAA
GAATAATTTTTGCTGTGCTTTCTTTAGTAAATAGAGTTAGGCAGGGATAC
TCACCTCTGTCATTGCAGACCCTTATCCCAAGCCCGAGGGGACCAGACAG
GCCCGGAGGAATCGAAGAAGAAGGTGGAGAGCAAGACAGAAACAGATCAA
CGCGATTAGTGAGCGGATTCTTAGCGCTTGCCTGGGACGACCTGCGGAGC
CTGTGCCTTTTCATCTACCACCGATTGAGAGACTTCATATTAATTGCAGC
GAGAGCGGGGGAACTTCTGGGACGCAGCAGTCTCAAGGGACTACGGAGAG
GGTGGGAAGCCCTTAAGTATCTGGGAAGTCTTGTGCAGTATTGGGGCCTG
GAACTAAAAAGGAGTGCTATTAGTCTATTGGATACCCTAGCAATAGCAGT
AGGTGAGGGAACAGATAGGATTCTAGAATTTGTATTAGGAATTTGTAGAG
CTATCCGCAACATACCTACAAGAATAAGACAGGGCTTTGAAACAGCTTTG Fig. 15 (cont.)
CTATAA
>w160.D1
ATGAGAGTGAGGGGGATACAGAGGAGTTATCCACAATGGTGGATATGGAG
CATGTTAGGCCTTTGGATGCTAATGATTTGTAATGGGATGTGGGTCACAG
TCTACTATGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAATGACATGGTGGATCAGATG
CATGAAGATGTAATTAGTTTATGGGATCAAAGCCTCAAGCCATGTGTAAG
GTTGACCCCACTCTGTGTCACTCTAAACTGTATCAATGCTACTAATGCTA
CTGCCAGCGATAGCAGTATATTAGATGGAATGAAAAATTGCTCTTTCAAT
ATAACCACAGAATTAAGAGATAAGAGAGAGAAAAAGAATGCACTTTTTTA
TAAACTTGATATAGTACAACTAGGTGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTAAAAATAT
AACAGACAATAGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAAATATAAGAGA
AGCACATTGTAACATTAGTGAAAGTAAATGGAATGAGACTTTACAAAGGG
TAAGTGAAAAATTAAAAAAATACTTCCCTGATAAGAATATAACATTTCAA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTACTAGTACAGATATGGCTAATAGTACAGAAACTAACATCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAACAATACAGAGGATACG
GAGACATTCAGACCTGTAGGAGGAAATATGAAGGACAATTGGAGCAGTGA
ATTATATAAATATAAAGTGGTAGAAGTTAAGCCATTAGGAGTAGCACCCA
CTAATGCAAGAAGGAGAGTGGTGGAGAGAGAAAAAGAGCAGTGGGAATG
GGAGCTGTGTTCCTTGGGTTCTTGGGAGCGGCAGGAAGCACTATGGGCGC
AGCATCAATAACGCTGACGGTACAGGCCAGACAATTATTGTCTGGTATAG
TGCAACAGCAAAGCAATTTGCTGAAGGCTATAGAGGCTCAACAGCATATG
TTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCT
CTGGAAAACTCATCTGCACCACTAATGTATATTGGAACTCTAGCTGGAGT
AATAAAACTTATAGTGATATTTGGGATAACATGACCTGGATGCAGTGGGA
GAGAGAAATTAGCAATTATACAGACATGATATATGAATTGCTTGAAGAAT
CACAAAACCAGCAGGAAAAGAATGAACAAGATTTACTAGCATTGGACAGA
TGGAACAGTCTGTGGAATTGGTTTAACATAACAAATTGGCTGTGGTATAT
AAAAATATTCATAATGATAGTAGGAGGTTTGATAGGTTTAAGAATAATTT
TTGCTGTGCTTTCTTTAGTAAATAGAGTTAGGCAGGGATACTCACCTCTG
TCATTGCAGACCCTTATCCCAAGCCCGAGGGGACCAGACAGGCCCGGAGG
AATCGAAGAAGAAGGTGGAGAGCAAGACAGAAACAGATCAACGCGATTAG
TGAGCGGATTCTTAGCGCTTGCCTGGGACGACCTGCGGAGCCTGTGCCTT
TTCATCTACCACCGATTGAGAGACTTCATATTAATTGCAGCGGAGAGCGGG
GGAACTTCTGGGACGCAGCAGTCTCAAGGGACTACGGAGAGGGTGGGAAG
CCCTTAAGTATCTGGGAAGTCTTGTGCAGTATTGGGGCCTGGAACTAAAA
AGGAGTGCTATTAGTCTATTGGATACCCTAGCAATAGCAGTAGGTGAGGG
AACAGATAGGATTCTAGAATTTGTATTAGGAATTTGTAGAGCTATCCGCA
ACATACCTACAAGAATAAGACAGGCTTTGAAACAGCTTTGCTATAA
>w160.D5
ATGAGAGTGAGGGGGATACAGAGGAGTTATCCACAATGGTGGATATGGAG
CATGTTAGGCTTTTGGATGCTAATGATTTGTAATGGGATGTGGGTCACAG
TCTACTATGGGTACCTGTGTGGAAAGAAGCAAAAACTACTCTATTTTGT
GCATCAGATGCTAAAGCATATGAGAAAGAAGTGCATAATGTCTGGGCTAC Fig. 15 (cont.)
ACATGCCTGTGTACCCACAGACCCCAATCCACAAGAAATGGTTTTAAAAA
ATGTAACAGAAAATTTCAACATGTGGGAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTATCAATGCTACTAATGCTA
CTGCCAGCGATAGCAGTATATTAGATGGAATGAAAAATTGCTCTTTCAAT
ATAACCACAGAATTAAGAGATAAGAGAGAGAAAAAGAATGCACTTTTTTA
TAAACTTGATATAGTACAACTAGGTAGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTAAAAATAT
AACAGACAATAGCAAAACAATAATAGTACATCTCAATGAATCTGTAAAGA
TTGAGTGTACGAGACCCAGTAATAACACAAGAACAAGTATAAGAATAGGA
CCAGGACAAGCATTTTATGCAACAGGACAAGTAATAGGAAATATAAGAGA
AGCACATTGTAACATTAGTGAAAGTAAATGGAATGAAACTTTACAAAGGG
TAAGTGAAAAATTAAAAGAATACTTCCCTGATAAGAATATAACATTTCAA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTAATAGTACAGATATGGCTAATAGTACAAACTAACAGTACACAA
ATCATCACAATCCACTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAACAATACA
GAGGATACGGAGACATTCAGACCTGTAGGAGGAAATATGAAGGACAATTG
GAGCAGTGAATTATATAAATATAAAGTGGTAGAAGTTAAGCCATTAGGAG
TAGCACCCACTAATGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA
CAGCATATGTTGAAACTCACGGTCTGGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGTTGGAGTAATAAAACTTATGATGATATTTGGGATAACATGACCTGGAT
GCAATGGGAGAGAGAAATTAGCAATTATACAGAAATAATATATGAATTGC
TTGAAGAATCACAAAACCAGCAGGAAAAGAATGAACAAGATTTACTAGCA
TTGGACAGATGGAACAGTCTGTGGAATTGGTTTAACATAACAAATTGGCT
GTGGTATATAAAAATATTCATAATGATAGTAGGAGGCTTGATAGGTTTAA
GAATAATTTTTGCTGTGCTTTCTTTAGTAAATAGAGTTAGGCAGGGATAC
TCACCTCTGTCATTGCAGACCCTTATCCCAAGCCCGAGGGGACCAGACAG
GCCCGGAGGAATCGAAGAAGAAGGTGGAGAGCAAGCAGAAACAGATCAA
CGCGATTAGTGAGCGGATTCTTAGCGCTTGCCTGGGACGACCTGCGGAGC
CTGTGCCTTTTCATCTACCACCGATTGAGAGACTTCATATTAATTGCAGC
GAGAGCGGGGGAACTTCTGGGACGCAGCAGTCTCAAGGGACTACGGAGAG
GGTGGGAAGCCCTTAAGTATCTGGGAAGTCTTGTACAGTATTGGGGCCTG
GAACTAAAAAGGAGTGCTATTAGTCTATTGGATACCCTAGCAATAGCAGT
AGGTGAGGGAACAGATAGGATTCTAGAATTTGTATTAGGAATTTGTAGAG
CTATCCGCAACATACCTACAAGAATAAGACAGGGCTTTGAAACAGCTTTG
CTATAA
>w160.T2
ATGAGAGTGAGGGGGATACAGAGGAGTTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACGGACCCCAATCCACAAGAAATGGTTTTAAAAA
ATGTAACAGAAAATTTCAACATGTGGAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTATCAATGCTACTAATGCTA
CTGCCAGCGATAGCAGTATATTAGATGGAATGAAAAATTGCTCTTTCAAT Fig. 15 (cont.)
ATAACCACAGAATTAAGAGATAAGAGAGAGAAAAAGAATGCACTTTTTTA
TAAACTTGATATAGTACAACTAGGTGGCAACTCTAGTCAGTATAGATTAA
TAAATTGTAATACCTCAGTCATAACACAAGCCTGTCCAAAGGTCTCTTTT
GACCCAATTCCTATACATTATTGTGCTCCAGCTGGTTATGCGATTCTAAA
GTGTAATAATAAGACATTCAATGGAACAGGACCGTGTAATAATGTCAGCA
CAGTACAATGTACACATGGAATTAAGCCAGTGGTTTCAACTCAACTATTG
TTAAATGGTAGCCTAGCAGAAGGAGAGATAATAATTAGATCTAAAAATAT
AACAGACAATAGCAAAACAATAATAGTACATCTCAATGAATCTGTAAAGA
TTGAGTGTACGAGACCCAGTAATAACAAGAACAAGTATAAGAATAGGA
CCAGGACAAGCATTTTATGCAACAGGACAAGTAATAGGAAATATAAGAGA
AGCACATTGTAACATTAGTGAAAGTAAATGGAATGAAACTTTACAAAGGG
TAAGTGAAAAATTAAAAGAATACTTCCCTGATAAGAATATAACATTTCAA
CCATCCTCAGGAGGGGACCTAGAAATTACAACACATAGCTTTAATTGTGG
AGGAGAATTTTTCTATTGCAATACATCAAGCCTGTTTAATAGGACATATA
TGGCTAATAGTACAGATATGGCTAATAGTACAGAAACTAACAGTACACAA
ATCATCACAATCCACTGCAGAATAAAACAAATTATAAACATGTGGCAGGA
GGTGGGACGAGCAATGTATGCCCCTCCCATTGCAGGAAACATAACATGTA
TATCAAATATCACAGGACTACTATTGACAAGGGATGGAGGAAACAATACA
GAGGATACGGAGACATTCAGACCTGTAGGAGGAAATATGAAGGACAATTG
GAGCAGTGAATTATATAAATATAAAGTGGTAGAAGTTAAGCCATTAGGAG
TAGCACCCACTAATGCAAGAAGGAGAGTGGTGGAGAGAGAAAAAAGAGCA
GTGGGAATGGGAGCTGTGTTCCTTGGGTTCTTGGGAGCGGCAGGAAGCAC
TATGGGCGCAGCATCAATAACGCTGACGGTACAGGCCAGACAATTATTGT
CTGGTATAGTGCAACAGCAAAGCAATTTGCTGAAGGCTATAGAGGCTCAA
CAGCATATGTTGAAACTCACGGTCTGGGGCATTAAACAGCTCCAGGCAAG
AGTCCTGGCCTTGGAAAGATACCTAAAGGATCAACAGCTCCTAGGGATGT
GGGGCTGCTCTGGAAAACTCATCTGCACCACTAATGTATATTGGAACTCT
AGCTGGAGTAATAAAACTTATAGTGATATTTGGGATAACATGACCTGGAT
GCAGTGGGAGAGAGAAATTAGCAATTATACAGACATGATATATGAACTGC
TTGAAGAATCACAAAACCAGCAGGAAAAGAATCAACAAGATTTACTAGCA
TTGGACAGATGGAACAGTCTATGGAATTGGTTTAACATAACAAATTGGCT
GTGGTATATAAAAATATTCATAATGATAGTAGGAGGCTTGATAGGTTTAA
GAATAATTTTTGCTGTGCTTTCTTTAGTAAATAGAGTTAGGCAGGGATAC
TCACCTCTGTCATTGCAGACCCTTATCCCAAGCCCGAGGGGACCAGACAG
GCCCGGAGGAATCGAAGAAGAAGGTGGAGAGCAAGACAGAAACAGATCAA
CGCGATTAGTGAGCGGATTCTTAGCGCTTGCCTGGGACGACCTGCGGAGC
CTGTGCCTTTTCATCTACCACCGATTGAGAGACTTCATATTAATTGCAGC
GAGAGCGGGGGAACTTCTGGGACGCAGCAGTCTCAAGGGACTACGGAGAG
GGTGGGAAGCCCTTAAGTATCTGGGAAGTCTTGTGCAGTATTGGGGCCTG
GAACTAAAAAGGAGTGCTATTAGTCTATTGGATACCCTAGCAATAGCAGT
AGGTGAGGGAACAGATAGGATTCTAGAATTTGTATTAGGAATTTGTAGAG
CTATCCGCAACATACCTACAAGAATAAGACAGGGCTTTGAAACAGCTTTG
CTATAA
>w160.T4
ATGAGAGTGATGGGGAGACAGAGGAATTATCCACAATGGTGGATATGGAG
CACGTTAGGCTTGCGGATGCTAATGATTTGTAATGGGATGTGGGTCACAG
TCTACTATGGGGTACCTGTGTGGAAAGAAGCAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGGAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCGATGCTAATGCTACTG
CCAGCAATGCTAATGCTACTGTCAGCAATACCAATGCTACTGTCAGCAAT
GATAGCAGTATAATAGAGGAAATGAAAAATTGCTCTTTCAATATAACCAC
AGAATTAAGAGATAAGATAGAGAAAAGTATGCACTTTTTTATAAACTTG
ATATAGTACAACTAGATGGCAACTCTACTCATTATAGATTCATAAATTGT
AATACCTCAGCCATAACACAAGCCTGTCCAAAGGTCTCTTTTGACCCAAT
TCCTATACATTATTGTGCTCCAGCTGGTTATGCGATTCTAAAGTGTAATA Fig. 15 (cont.)
ATAAGACATTCAATGGAACAGGACCGTGTAATAATGTCAGCACAGTACAA
TGTACACATGGAATTAAGCCAGTGGTTTCAACTCAACTATTGTTAAATGG
TAGCCTAGCAGAAGGAGAGATAATAATTAGATCTGAAAATATAACAGACA
ATGCCAAAACAATAATAGTACATCTCAATGAATCTGTAAAGATTGAGTGT
ACGAGACCCAGTAATAACACAAGAACAAGTATAGGAATAGGACCAGGACA
AGCATTTTATGCAACAGGACAAGTAATAGGAGACATAAGAAAAGCACATT
GTAACATTAGTGAAAGTAAATGGAATGAAACTTTACAAAGGGTAAGTAAA
AAATTAAAAGAATACTTCCCTGGTAAGAATATAACATTTCAACCATCCTC
AGGAGGGGACCCAGAAGTTACAACACATAGCTTTAATTGTGGAGGAGAAT
TTTTCTATTGCAATACATCAAGCCTGTTTAATAGGACATATATGACTAAT
AGTACAGATATGGCTAATAGTACAGAAACTAACAGAACCATCACAATCCA
CTGCAGAATAAAACAAATTATAAACATGTGGCAAGAGGTGGGACGAGCAA
TGTATGCCCCTCCCATTGCAGGAAACATAACATGTATATCAAATATCACA
GGACTACTATTGACAAGGGATGGAGGAAACAATACGGATCCGGAGATATT
CAGACCTGGAGGAGGAAATATGAAGGACAATTGGAGAAGTGAATTATATA
AATATAAAGTGGTAGAAGTTAAGCCATTAGGAGTAGCACCCACTAATGCA
AGAAGGAGAGTGGTGGAGAGAGAAAAAGAGCAGTGGGAATGGGAGCTGT
GTTCCTTGGGTTCTTGGGAGCGGCAGGAAGCACTATGGGCGCAGCGTCAA
TAACGCTGACGGTACAGGCCAGACAACTATTGTCTGGTATAGTGCAACAG
CAAAGCAATTTGCTGAAGGCTATAGAGGCTCAACAGCACATGTTGAGACT
CACGGTCTGGGGCATTAAACAGCTCCAGGCAAGAGTCCTGGCCTTGGAAA
GATACCTAAAGGATCAACAGCTCCTAGGGATGTGGGGCTGCTCTGGAAAA
CTCATTTGCACCACTAATGTATATTGGAACTCTAGTTGGAGTAATAAAAC
TTATGGTGATATTTGGGATAACATGACCTGGATGCAGTGGGAGAGCGAAA
TTAGCAATTATACAAACATAATATATGATTTGCTTGAAGAATCACAAAAC
CAGCAGGAAAAGAATGAACAAGATTTACTAGCATTGGACAGATGGAACAG
TCTGTGGAATTGGTTTAACATAACAAAATGGCTGTGGTATATAAAAATAT
TCATAATGATAGTAGGAGGCTTGATAGGTTTAAGAATAATTTTTGCTGTG
CTTTCTTTAGTAAATAGAGTTAGGCAGGGATACTCACCTCTGTCGTTGCA
GACCCTTATCCCAAGCCCGAGGGGACCAGACAGGCCCGGAGGAATCGAAG
AAGAAGGTGGAGAGCAAGACAGAAAGAGATCAACGCGATTAGTGAGCGGA
TTCTTAGCGCTTGTCTGGGACGACCTGCGGAGCCTGTGCCTTTTCCTCTA
CCACCGATTGAGAGACTTCATATTAATTGCAGCGAGAGCGGGGGAACTTC
TGGGACGCAGCAGTCTCAAGGGACTACGGAGAGGGTGGGAAGCCCTTAAG
TATCTGGGAAGTCTTGTGCAGTATTGGGGCCTGGAACTAAAAAGGAGTGC
TATTAGTCTATTGGATACCCTAGCAATAGCAGTAGGTGAAGGAACAGATA
GGATTCTAGAATTTGTATTAGGAATTTGTAGAGCTATCCGCAACATACCT
ACAAGAATAAGACAGGGCTTTGAAACAGCTTTGCTATAA
>M5
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAAATTGCTCTTTCAATATAACCACA
GAATTAAGAGATAAGAGAGAGAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAAAAA
TGTCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG

Fig. 15 (cont.)
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA
>M19
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGACAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
ATCCACTGCAGAATAAAACAAATTATAAACATGTGGCAGGAGGTGGGACG

Fig. 15 (cont.)
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA
>M10
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGGCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACAGAACCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC

Fig. 15 (cont.)

```
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA
>M11
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAGACAA
TGGCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
```

Fig. 15 (cont.)
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA
>M9
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTAAAAATATAACAGACAA
TGGCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
ATCCACTGCAGAATAAAACAAATTTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAGGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA

Fig. 15 (cont.)
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA
>M7
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTAAAAATATAACAGACAA
TAGCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA Fig. 15 (cont.)
TAGGATTCTAGAATTTGTATTAGGAATTTGTAGAGCTATCCGCAACATAC
CTACAAGAATAAGACAGGGCTTTGAAACAGCTTTGCTATAA
>M20
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAG
TGGCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA
>M8
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT Fig. 15 (cont.)
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAG
TGCCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA
>M21
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAAATTGCTCTTTCAATATAACCACA

Fig. 15 (cont.)

GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAC
TGCCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA

>M6
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAACTACTCTATTTTGT
GCATCAGATGCTAAAGCATATGAGAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGGAGGGATGAAAAATTGCTCTTTCAATATAACCACA
GAATTAAGAGATAAGAGAGAGAAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT

Fig. 15 (cont.)
GTACACATGGAATTAAGCCAGTGGTTTCAACTCAACTATTGTTAAATGGT
AGCCTAGCAGAAGGAGAGATAATAATTAGATCTGAAAATATAACAAACAA
TGCCAAAACAATAATAGTACATCTCAATGAATCTGTAAAGATTGAGTGTA
CGAGACCCAATAATAAAACAAGAACAAGTATAAGAATAGGACCAGGACAA
GCATTTTATGCAACAGGACAAGTAATAGGAGACATAAGAGAAGCATATTG
TAACATTAATGAAAGTAAATGGAATGAAACTTTACAAAGGGTAAGTAAAA
AATTAAAAGAATACTTCCCTCATAAGAATATAACATTTCAACCATCCTCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAGTACACGAACCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATACGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTGCTATAA >w014.12
ATGAGAGTGATGGGGATACAGAGGAATTATCCACAATGGTGGATATGGAG
CATGTTAGGCTTTTGGATGCTAATGATTTGTAATGGGATGTGGGTCACAG
TCTACTATGGGGTACCTGTGTGGAAAGAAGCAAAACTACTCTATTTTGT
GCATCAGATGCTAAAGCATATGAGAAAGAAGTGCATAATGTCTGGGCTAC
ACATGCCTGTGTACCCACAGACCCCAATCCACAAGAAATGGTTTTAAAAA
ATGTAACAGAAAATTTCAACATGTGGAAAAATGACATGGTGGATCAGATG
CATGAAGATGTAATTAGTTTATGGGATCAAAGCCTCAAGCCATGTGTAAA
GTTGACCCCACTCTGTGTCACTCTAAACTGTACCAATGCTACTGCCAGCA
ATAGCAGTATAATAGAGGGAATGAAAATTGCTCTTTCAATATAACCACA
GAATTAAGAGATAAGAGAGAGAAAAGAATGCACTTTTTTATAAACTTGA
TATAGTACAACTAGATGGCAACTCTAGTCAGTATAGATTAATAAATTGTA
ATACCTCAGTCATAACACAAGCCTGTCCAAAGGTCTCTTTTGACCCAATT
CCTATACATTATTGTGCTCCAGCTGGTTATGCGATTCTAAAGTGTAATAA
TAAGACATTCACTGGAACAGGACCGTGTAATAATGTCAGCACAGTACAAT
GTACACATGGAATTAAGCCAGTGGTTTCAACTCAACTATTGTTAAATGGT
AGCCTAGCAGAAGGAGAGATAATAATTAGATCTGAAAATATAACAAACAA
TGTCAAAACAATAATAGTACATCTCAATGAATCTGTAAAGATTGAGTGTA
CGAGACCCAATAATAAAACAAGAACAAGTATAAGAATAGGACCAGGACAA

Fig. 15 (cont.)

```
GCATTTTATGCAACAGGACAAGTAATAGGAGACATAAGAGCAGCATATTG
TAACATTAATGAAAGTAAATGGAATGAAACTTTACAAAGGGTAAGTAAAA
AATTAAAAGAATACTTCCCTCATAAGAATATAACATTTCAACCATCCCCA
GGAGGGGACCTAGAAATTACAACACATAGCTTTAATTGTGGAGGAGAATT
TTTCTATTGCAATACATCAAGCCTGTTTAATAGGACATATATGGCTAATA
GTACAGATATGGCTAATAGTACAGAAACTAACAATACACGAACCATCACA
ATCCACTGCAGAATAAAACAAATTATAAACATGTGGCAGGAGGTGGGACG
AGCAATGTATGCCCCTCCCATTGCAGGAAACATAACATGTATATCAAATA
TCACAGGACTACTATTGACAAGGGATGGAGGAAAAAACAATGCGGAGACA
TTCAGACCTGGAGGAGGAAATATGAAGGACAATTGGAGAAGTGAATTATA
TAAATATAAAGTGGTAGAAGTTAAGCCATTAGGAGTAGCACCCACTAATG
CAAGAAGGAGAGTGGTGGAGAGAGAAAAAAGAGCAGTGGGAATGGGAGCT
GTGTTCCTTGGGTTCTTGGGAGCGGCAGGAAGCACTATGGGCGCAGCATC
AATAACGCTGACGGTACAGGCCAGACAATTATTGTCTGGTATAGTGCAAC
AGCAAAGCAATTTGCTGAAGGCTATAGAGGCTCAACAGCATATGTTGAAA
CTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAA
AACTCATCTGCACCACTAATGTATATTGGAACTCTAGTTGGAGTAATAAA
ACTTATGGTGATATTTGGGATAACATGACCTGGATGCAGTGGGAGAGAGA
AATTAGCAATTATACAGAAATAATATATGAATTGCTTGAAGAATCACAAA
ACCAGCAGGAAAAGAATGAACAAGATTTACTAGCATTGGACAGATGGAAC
AGTCTGTGGAATTGGTTTAACATAACAAATTGGCTGTGGTATATAAAAAT
ATTCATAATGATAGTAGGAGGCTTGATAGGTTTAAGAATAATTTTTGCTG
TGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGA
AGAAGAAGGTGGAGAGCAAGACAGAAACAGATCAACGCGATTAGTGAGCG
GATTCTTAGCGCTTGTCTGGGACGACCTGCGGAGCCTGTGCCTTTTCATC
TACCACCGATTGAGAGACTTCATATTAATTGCAGCGAGAGCGGGGGAACT
TCTGGGACGCAGCAGTCTCAAGGGACTACGGAGAGGATGGGAAGCCCTTA
AGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGA
TAGGATTCTAGAATTTGTATTAGGAATTTGTAGAGCTATCCGCAACATAC
CTACAAGAATAAGACAGGGCTTTGAAACAGCTTTTGCTATAA
```

Fig. 16
(DNA sequences of 103 CH505Dgp120s)

The coding region of CH505 HIV-1 Env gene inserts are in upper case.

>HV1300531_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
GAACGTGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCACTGCCGCATCAAGCAGATCATCAACATGTGGC
AGGAGGTGGGCCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGgtgaccgaattc
gggacccggatcc
>HV1300532_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGCGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCACTGCCGCATCAAGCAGATCATCAACATGTGGC
AGGAGGTGGGCCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGgtcaccgaattc
gggacccggatcc
>HV1300533_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA Fig. 16 (cont.)
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCGAAGAACATCACGGA
CAACTCGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGgtaaccgaattc
gggacccggatcc
>HV1300534_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCGGAGAACATCACGAA
CTCGGCGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGgttaccgaattc
gggacccggatcc
>HV1300535_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCGAAGAACATCACGGA
CAACGGGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGgtgaccgaattc
gggtcccggatcc
>HV1300536_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC Fig. 16 (cont.)
CCGCTGTGCGTGACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGGGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAgtgaccgaattc
aggacccggatcc
>HV1300537_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCTGCGTGAAGCTGACC
CCGCTGTGCGTGACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGGA
CAACGGGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAgtgaccgaattc
aggtcccggatcc
>HV1300538_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGACAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAgtgaccgaattc
gggacctggatcc
>HV1300539_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG Fig. 16 (cont.)
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CTCGGGGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGgtgaccgaattc
gggtcctggatcc
>HV1300540_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CACGGCGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGgtcaccgaattc
gggtcccggatcc
>HV1300541_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGTGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGggatcc
>HV1300542_v2

Fig. 16 (cont.)

```
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
GAACGTGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAgtcaccgaattc
gggacctggatcc
>HV1300543_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGTGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCGCTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAgtcaccgaattc
gggtcctggatcc
>HV1300544_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGTCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGTGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCAAGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
```

Fig. 16 (cont.)
GTGGAGGTGAAGCCCCTGGGCGTGGCACCCACCAACGCCCGCGAGCGCGTCGTGGAGCGCGAGAAGGAGTAGTAAGgtaaccgaattc
gggtcccggatcc
>HV1300545_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGTTCCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACTCCTCCATCATCGAGCGGATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGTGAAGACCATCATCGTGCACCTGAACGAGTCCGTGAAGATCGAGTGCACCCGCCCGAACAACAAGACGCGCGCCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCGCTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGgtaaccgaattc
aggacccggatcc
>HV1300546_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCATCACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGGGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCATCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGgtaaccgaattc
aggtcccggatcc
>HV1300547_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGGGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCATCATCACGATCCACTGCCGCATCAAGCAGATCATCAACATGTGGC Fig. 16 (cont.)
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGgtaaccgaattc
gggacctggatcc
>HV1300548_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGTGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCAAGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGgtaaccgaattc
gggtcctggatcc
>HV1300549_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACACGAACGCCACGGCCTCGAACTCCTCCACGATCGAGGGCATGA
AGAACTGCTCCTTCAACATCACGACGGAGCTGCGCGACAAGCGCGAGAAGAAGAACGCCCTGTTCTACAAGCTGGACATCGTGCAGCT
GGACGGCAACTCCTCGCAGTACAGGCTGATCAACTGCAACACCTCCGTCATCACGCAGGCGTGCCCCAAGGTGTCCTTCGACCCCATC
CCCATCCACTACTGCGCCCCCGCCGGCTACGCCATCCTGAAGTGCAACAACAAGACCTTCACCGGCACCGGCCCGTGCAACAACGTGT
CCACCGTGCAGTGCACGCACGGGATCAAGCCCGTGGTGTCCACGCAGCTGCTCCTGAACGGGTCGCTGGCCGAGGGCGAGATCATCAT
CCGGTCCGAGAACATCACGAACAACGCGAAGACCATCATCGTGCACCTGAACGAGTCCGTGAAGATCGAGTGCACCCGCCCGAACAAC
AAGACGCGCACCTCCATCCGGATCGGCCCTGGCCAGGCCTTCTACGCCACCGGCCAGGTGATCGGCAACATCCGCGAGGCGTACTGCA
ACATCTCGGAGTCCAAGTGGAACGAGACCCTGCAGCGCGTGTCCAAGAAGCTGAAGGAGTACTTCCCCCACAAGAACATCACCTTCCA
GCCGTCGTCCGGCGGCGACCTCGAGATCACCACGCACTCCTTCAACTGCGGTGGCGAGTTCTTCTACTGCAACACGTCGTCGCTGTTC
AACCGCACCTACATGGCCAACTCCACCGACATGGCCAACTCCACCGAGACCAACTCCACGCGCATCATCACGATCCACTGCCGCATCA
AGCAGATCATCAACATGTGGCAGGAGGTGGGCCGCGCCATGTACGCACCGCCCATCGCCGGCAACATCACCTGCATCTCCAACATCAC
CGGCCTCCTGCTGACCCGCGACGGCGGCAAGAACAACACGGAGACCTTCAGGCCAGGCGGAGGCAACATGAAGGACAACTGGCGCTCC
GAGCTGTACAAGTACAAGGTGGTGGAGGTGAAGCCCCTGGGCGTGGCACCCACCAACGCCCGCGAGCGCGTCGTGGAGCGCGAGAAGG
AGTAGTAAGgttaccgaattcgggtcccggatcc
>HV1300550_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGAACAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGGGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCTCGGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT Fig. 16 (cont.)
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCGCTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGgtcaccgaattc
aggacccggatcc
>HV1300551_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCAACGCGTCCAACAACTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGGGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCTCGGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCATCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGgttaccgaattc
aggacccggatcc
>HV1300552_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGAACAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGCGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCAACATCCGCGAGGCGTACTGCAACATCTCGGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGCTCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGgttaccgaattc
aggtcccggatcc
>HV1300553_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCGCGTCCAACTCCTCCATCATCGAGGGCATGAAGAACTGCTCCTTCAACATCACGA
CGGAGCTGCGCGACAAGCGCGAGAAGAAGAACGCCCTGTTCTACAAGCTGGACATCGTGCAGCTGGACGGCAACTCCTCGCAGTACAG
GCTGATCAACTGCAACACCTCCGTCATCACGCAGGCGTGCCCCAAGGTGTCCTTCGACCCCATCCCCATCCACTACTGCGCCCCCGCC
GGCTACGCCATCCTGAAGTGCAACAACAAGACCTTCACCGGCACCGGCCCGTGCAACAACGTGTCCACCGTGCAGTGCACGCACGGGA
TCAAGCCCGTGGTGTCCACGCAGCTGCTCCTGAACGGGTCGCTGGCCGAGGGCGAGATCATCATCCGGTCCGAGAACATCACGAACAA
CGCGAAGACCATCATCGTGCACCTGAACGAGTCCGTGAAGATCGAGTGCACCCGCCCGAACAACAAGACGCGCACCTCCATCCGGATC

Fig. 16 (cont.)
```
GGCCCTGGCCAGGCCTTCTACGCCACCGGCCAGGTGATCGGCGACATCCGCAAGGCGTACTGCAACATCAACGAGTCCAAGTGGAACG
AGACCCTGCAGCGCGTGTCCAAGAAGCTGAAGGAGTACTTCCCCCACAAGAACATCACCTTCCAGCCGTCGTCCGGCGGCGACCTCGA
GATCACCACGCACTCCTTCAACTGCGGTGGCGAGTTCTTCTACTGCAACACGTCGTCGCTGTTCAACCGCACCTACATGGCCAACTCC
ACCGACATGGCCAACTCCACCGAGACCAACAACACGCGCACCATCACGATCCACTGCCGCATCAAGCAGATCATCAACATGTGGCAGG
AGGTGGGCCGCGCCATGTACGCACCGCCCATCGCCGGCAACATCACCTGCATCTCCAACATCACCGGCCTCCTGCTGACCCGCGACGG
CGGCAAGAACAACACGGAGACCTTCAGGCCAGGCGGAGGCAACATGAAGGACAACTGGCGCTCCGAGCTGTACAAGTACAAGGTGGTG
GAGGTGAAGCCCCTGGGCGTGGCACCCACCAACGCCCGCGAGCGCGTCGTGGAGCGCGAGAAGGAGTAGTAAGgttaccgaattcggg
acctggatcc
>HV1300554_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCACGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGTGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCCGGAACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCAAGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGgttaccgaattc
gggtcctggatcc
>HV1300555_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACGCCACGGCCTCGAACTCCTCCATCATCGAGGGCATGAAGAACT
GCTCCTTCAACATCACGACGGAGCTGCGCGACAAGCGCGAGAAGAAGAACGCCCTGTTCTACAAGCTGGACATCGTGCAGCTGGACGG
CAACTCCTCGCAGTACAGGCTGATCAACTGCAACACCTCCGTCATCACGCAGGCGTGCCCCAAGGTGTCCTTCGACCCCATCCCCATC
CACTACTGCGCCCCCGCCGGCTACGCCATCCTGAAGTGCAACAACAAGACCTTCACCGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTC
CGAGAACATCACGAACAACGTGAAGACCATCATCGTGCACCTGAACGAGTCCGTGAAGATCGAGTGCACCCGCCCGAACAACAAGACG
CGCAAGTCCATCCGGATCGGCCCTGGCCAGGCCTTCTACGCCACCGGCCAGGTGATCGGCGACATCCGCGAGGCGTACTGCAACATCA
ACGAGTCCAAGTGGAACGAGACCCTGCAGCGCGTGTCCAAGAAGCTGAAGGAGTACTTCCCCCACAAGAACATCACCTTCCAGCCGTC
GTCCGGCGGCGACCTCGAGATCACCACGCACTCCTTCAACTGCGGTGGCGAGTTCTTCTACTGCAACACGTCGTCGCTGTTCAACCGC
ACCTACATGGCCAACTCCACCGACATGGCCAACTCCACCGAGACCAACTCCACGCGCACCATCACGATCCGCTGCCGCATCAAGCAGA
TCATCAACATGTGGCAGGAGGTGGGCCGCGCCATGTACGCACCGCCCATCGCCGGCAACATCACCTGCATCTCCAACATCACCGGCCT
CCTGCTGACCCGCGACGGCGGCAAGAACAACACGGAGACCTTCAGGCCAGGCGGAGGCAACATGAAGGACAACTGGCGCTCCGAGCTG
TACAAGTACAAGGTGGTGGAGGTGAAGCCCCTGGGCGTGGCACCCACCAACGCCCGCGAGCGCGTCGTGGAGCGCGAGAAGGAGTAGT
AAGggacccgaattcggtgaccggatcc
>HV1300556_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACAACTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
```

Fig. 16 (cont.)
GGATCAAGCCCGTGGTGTCCACGCAGCTGCTCCTGAACGGGTCGCTGGCCGAGGGCGAGATCATCATCCGGTCCGAGAACATCACGAA
CAACGCGAAGACCATCATCGTGCACCTGAACGAGTCCGTGAAGATCGAGTGCACCCGCCCGAACAACAAGACGCGCACGTCCATCCGG
ATCGGCCCTGGCCAGGCCTTCTACGCCACCGGCCAGGTGATCGGCGACATCCGCAAGGCGTACTGCAACATCTCGGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGCTCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGggacccgaattc
ggtcaccggatcc
>HV1300557_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCACGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGTGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCTCGGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACAACACGCGCACCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGggacccgaattc
ggtaaccggatcc
>HV1300558_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCACGTCCAACGCCCTCGAACTCCTCCATCATCGAGGGCATGAAGAACT
GCTCCTTCAACATCACGACGGAGCTGCGCGACAAGCGCGAGAAGAAGAACGCCCTGTTCTACAAGCTGGACATCGTGCAGCTGGACGG
CAACTCCTCGCAGTACAGGCTGATCAACTGCAACACCTCCGTCATCACGCAGGCGTGCCCCAAGGTGTCCTTCGACCCCATCCCCATC
CACTACTGCGCCCCCGCCGGCTACGCCATCCTGAAGTGCAACAACAAGACCTTCACCGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTC
CGAGAACATCACGAACAACGTGAAGACCATCATCGTGCACCTGAACGAGTCCGTGAAGATCGAGTGCACCCGCCCGAACAACAAGACG
CGCAAGTCCATCCGGATCGGCCCTGGCCAGGCCTTCTACGCCACCGGCCAGGTGATCGGCGACATCCGCGAGGCGTACTGCAACATCT
CCGAGTCCAAGTGGAACGAGACCCTGCAGCGCGTGTCCAAGAAGCTGAAGGAGTACTTCCCCCACAAGAACATCACCTTCCAGCCGTC
GTCCGGCGGCGACCTCGAGATCACCACGCACTCCTTCAACTGCGGTGGCGAGTTCTTCTACTGCAACACGTCGTCGCTGTTCAACCGC
ACCTACATGGCCAACTCCACCGACATGGCCAACTCCACCGAGACCAACTCCACGCGCACCATCACGATCCGCTGCCGCATCAAGCAGA
TCATCAACATGTGGCAGGAGGTGGGCCGCGCCATGTACGCACCGCCCATCGCCGGCAACATCACCTGCATCTCCAACATCACCGGCCT
CCTGCTGACCCGCGACGGCGGCAAGAACAACACGGAGACCTTCAGGCCAGGCGGAGGCAACATGAAGGACAACTGGCGCTCCGAGCTG
TACAAGTACAAGGTGGTGGAGGTGAAGCCCCTGGGCGTGGCACCCACCAACGCCCGCGAGCGCGTCGTGGAGCGCGAGAAGGAGTAGT
AAGggacccgaattcggttaccggatcc
>HV1300559_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCACGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA Fig. 16 (cont.)
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGTGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCTCGGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCGCTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGCGGCACCCACCAACGCCCGCGAGCGCGTCGTGGAGCGCGAGAAGGAGTAGTAAGggtcccgaattc
ggtgaccggatcc
>HV1300560_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCACGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGCGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCAAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACAACACGCGCACCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGaggacccgaatt
cggtgaccggatcc
>HV1300561_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCACGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGCGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCAAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCGCTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGaggtcccgaatt
cggtgaccggatcc
>HV1300562_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC

Fig. 16 (cont.)
```
CCGCTGTGCGTGACCCTGAACTGCACCAACGCCACCGCGTCCAACATCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGGGAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCTCGGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCATCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGggacctgaattc
ggtgaccggatcc
>HV1300563_v2
gtgtcgacaagaagccaccATGCGCGTGATGGGCATCCAGCGCAACTACCCGCAGTGGTGGATCTGGTCGATGCTGGGCTTCTGGATG
CTCATGGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCGACGGCCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAA
CTCCCTCGCAGTACAGGCTGATCAACTGCAACACCTCCGTCATCACGCAGGCGTGCCCCAAGGTGTCCTTCGACCCCATCCCCATCCAC
TACTGCGCCCCCGCCGGCTACGCCATCCTGAAGTGCAACAACAAGACCTTCACCGGCACCGGCCCGTGCAACAACGTGTCCACCGTGC
AGTGCACGCACGGGATCAAGCCCGTGGTGTCCACGCAGCTGCTCCTGAACGGGTCGCTGGCCGAGGGCGAGATCATCATCCGGTCCGA
GAACATCACGAACAACGGGAAGACCATCATCGTCCAGCTCAACGAGTCCGTGAAGATCGAGTGCACCCGCCCGAACAACAAGACGCGC
ACCTCCATCCGGATCGGCCCTGGCCAGGCCTTCTACGCCACCGGCCAGGTGATCGGCAACATCCGCGAGGCGTACTGCAACATCAGCG
AGTCCAAGTGGAACGAGACCCTGCAGCGCGTGTCCAAGAAGCTGAAGGAGTACTTCCCCCACAAGAACATCACCTTCCAGCCGTCGTC
CGGCGGCGACCTCGAGATCACCACGCACTCCTTCAACTGCGGTGGCGAGTTCTTCTACTGCAACACGTCGTCGCTGTTCAACCGCACC
TACATGGCCAACTCCACCGACATGGCCAACTCCACCGAGACCAACTCCACGCGCATCATCACGATCCACTGCCGCATCAAGCAGATCA
TCAACATGTGGCAGGAGGTGGGCCGCGCCATGTACGCACCGCCCATCGCCGGCAACATCACCTGCATCTCCAACATCACCGGCCTCCT
GCTGACCCGCGACGGCGGCAAGAACAACACCGACACGGAGACCTTCAGGCCAGGCGGAGGCAACATGAAGGACAACTGGCGCTCCGAG
CTGTACAAGTACAAGGTGGTGGAGGTGAAGCCCCTGGGCGTGGCACCCACCAACGCCCGCGAGCGCGTCGTGGAGCGCGAGAAGGAGT
AGTAAGggtcctgaattcggtgaccggatcc
>HV1300564_v2
gtgtcgacaagaagccaccATGCGCGTGATGGGCATCCAGCGCAACTACCCGCAGTGGTGGATCTGGTCGATGCTGGGCTTCTGGATG
CTCATGGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCGACGACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAA
CTCCCTCGCAGTACAGGCTGATCAACTGCAACACCTCCGTCATCACGCAGGCGTGCCCCAAGGTGTCCTTCGACCCCATCCCCATCCAC
TACTGCGCCCCCGCCGGCTACGCCATCCTGAAGTGCAACAACAAGACCTTCACCGGCACCGGCCCGTGCAACAACGTGTCCACCGTGC
AGTGCACGCACGGGATCAAGCCCGTGGTGTCCACGCAGCTGCTCCTGAACGGGTCGCTGGCCGAGGGCGAGATCATCATCCGGTCCGA
GAACATCACGAACAACGCGAAGACCATCATCGTGCACCTGAACGAGTCCGTGAAGATCGAGTGCACCCGCCCGAGCAACAAGACGCGC
ACCTCCATCCGGATCGGCCCTGGCCAGGCCTTCTACGCCACCGGCCAGGTGATCGGCGACATCCGCGAGGCGTACTGCAACATCAGCG
AGTCCAAGTGGAACGAGACCCTGCAGCGCGTGTCCAAGAAGCTGAAGGAGTACTTCCCCCACAAGAACATCACCTTCCAGCCGTCGTC
CGGCGGCGACCTCGAGATCACCACGCACTCCTTCAACTGCGGTGGCGAGTTCTTCTACTGCAACACGTCGTCGCTGTTCAACCGCACC
TACATGGCCAACTCCACCGACATGGCCAACTCCACCGAGACCAACTCCACGCGCACCATCACGATCGTGCCGCATCAAGCAGATCA
TCAACATGTGGCAGGAGGTGGGCCGCGCCATGTACGCACCGCCCATCGCCGGCAACATCACCTGCATCTCCAACATCACCGGCCTCCT
GCTGACCCGCGACGGCGGCAAGAACAACACGGACACGGAGACCTTCAGGCCAGGCGGAGGCAACATGAAGGACAACTGGCGCTCCGAG
CTGTACAAGTACAAGGTGGTGGAGGTGAAGCCCCTGGGCGTGGCACCCACCAACGCCCGCGAGCGCGTCGTGGAGCGCGAGAAGGAGT
AGTAAGggtcccgaattcggtcaccggatcc
>HV1300565_v2
gtgtcgacaagaagccaccATGCGCGTGATGGGCATCCAGCGCAACTACCCGCAGTGGTGGATCTGGTCGATGCTGGGCTTCTGGATG
CTCATGGATCTGCAACGGCGTGCCGGTGTGGAAGGAGGCCAAGACGACCCTGTTCTGCGCGTCGGACGCCAAGGCCTACGAGAAGGAGG
```

Fig. 16 (cont.)
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCGACGGCGAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAA
CTCCTCGCAGTACAGGCTGATCAACTGCAACACCTCCGTCATCACGCAGGCGTGCCCCAAGGTGTCCTTCGACCCCATCCCCATCCAC
TACTGCGCCCCGCCGGCTACGCCATCCTGAAGTGCAACAACAAGACCTTCAACGGCACCGGCCCGTGCAACAACGTGTCCACCGTGC
AGTGCACGCACGGGATCAAGCCCGTGGTGTCCACGCAGCTGCTCCTGAACGGGTCGCTGGCCGAGGGCGAGATCATCATCCGGTCCGA
GAACATCACGAACAACGTGAAGACCATCATCGTGCACCTGAACGAGTCCGTGAAGATCGAGTGCACCCGCCCGAACAACAAGACGCGC
ACCTCCATCCGGATCGGCCCTGGCCAGGCCTTCTACGCCACCGGCCAGGTGATCGGCGACATCCGCGAGGCGCACTGCAACATCAGCG
AGTCCAAGTGGAACAAGACCCTGCAGCGCGTGTCCAAGAAGCTGAAGGAGTACTTCCCCCACAAGAACATCACCTTCCAGCCGTCGTC
CGGCGGCGACCTCGAGATCACCACGCACTCCTTCAACTGCGGTGGCGAGTTCTTCTACTGCAACACGTCGTCGCTGTTCAACCGCACC
TACATGGCCAACTCCACCGACATGGCCAACTCCACCGAGACCAACTCCACGCGCACCATCACGATCCGGTGCCGCATCAAGCAGATCA
TCAACATGTGGCAGGAGGTGGGCCGCGCCATGTACGCACCGCCCATCGCCGGCAACATCACCTGCATCTCCAACATCACCGGCCTCCT
GCTGACCCGCGACGGCGGCAAGAACAACACCGACACGGAGACCTTCAGGCCAGGCGGAGGCAACATGAAGGACAACTGGCGCTCCGAG
CTGTACAAGTACAAGGTGGTGGAGGTGAAGCCCCTGGGCGTGGCACCCACCAACGCCCGCGAGCGCGTCGTGGAGCGCGAGAAGGAGT
AGTAAGaggacccgaattcggtcaccggatcc
>HV1300566_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCACGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGACAAGACCATCATCGTGCACCTGAACGAGTCCGTGAAGATCGAGTGCACCCGCCCGAACAACAACACGCGCACCTCCATCCGG
ATCGGCCCTGGCCAGGCCTTCTACGCCACCGGCCAGGTGATCGGCGACATCCGCGAGGCGTACTGCAACATCTCGGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCATCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGaggtcccgaatt
cggtcaccggatcc
>HV1300567_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAAGGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCCACCGCGTCCAACATCTCCATCGAGGAGATGAAGAACTGCTCCTTCAACATCACGA
CGGAGCTGCGCGACAAGCGCGAGAAGAAGAACGCCCTGTTCTACAAGCTGGACATCGTGCAGCTGGACGGCAACTCCTCGCAGTACAG
GCTGATCAACTGCAACACCTCCGTCATCACGCAGGCGTGCCCCAAGGTGTCCTTCGACCCCATCCCCATCCACTACTGCGCCCCCGCC
GGCTACGCCATCCTGAAGTGCAACAACAAGACCTTCACCGGCACCGGCCCGTGCAACAACGTGTCCACCGTGCAGTGCACGCACGGGA
TCAAGCCCGTGGTGTCCACGCAGCTGCTCCTGAACGGGTCGCTGGCCGAGGGCGAGATCATCATCCGGTCCGAGAACATCACGGACAA
CGTGAAGACCATCATCGTGCACCTGAACGAGTCCGTGAAGATCGAGTGCACCCGCCCGAACAACAAGACGCGCACCTCCATCCGGATC
GGCCCTGGCCAGGCCTTCTACGCCACCGGCCAGGTGATCGGCGACATCCGCGAGGCGTACTGCAACATCTCGGAGTCCAAGTGGAACG
AGACCCTGCAGCGCGTGTCCAAGAAGCTGAAGGAGTACTTCCCCCACAAGAACATCACCTTCCAGCCGTCGTCCGGCGGCGACCTCGA
GATCACCACGCACTCCTTCAACTGCGGTGGCGAGTTCTTCTACTGCAACACGTCGTCGCTGTTCAACCGCACCTACATGGCCAACAAC
TCCACCGAGACCAACTCCACGCGCACCATCACGATCCGGTGCCGCATCAAGCAGATCATCAACATGTGGCAGGAGGTGGGCCGCGCCA
TGTACGCACCGCCCATCGCCGGCAACATCACCTGCATCTCCAACATCACCGGCCTCCTGCTGACCCGCGACGGCGGCAAGAACAACAC
CGACACGGAGACCTTCAGGCCAGGCGGAGGCAACATGAAGGACAACTGGCGCTCCGAGCTGTACAAGTACAAGGTGGTGGAGGTGAAG
CCCCTGGGCGTGGCACCCACCAACGCCCGCGAGCGCGTCGTGGAGCGCGAGAAGGAGTAGTAAGggacctgaattcggtcaccggatc
c
>HV1300568_v2

Fig. 16 (cont.)

gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGATGACC
CCGCTGTGCGTGACCCTGAACTGCACCAACGCCACCGCGATCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGACAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGTACTGCAACATCTCGGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACAACACGCGCCCCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCATCGCACCCACCAACGCCCGCGAGCGCGTCGTGGAGCGCGAGAAGGAGTAGTAAGggtcctgaattc
ggtcaccggatcc
>HV1300569_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGGGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCGACGGCCTCCAACGCCACCGCGTCCAACTCCTCCATCATCGAGGGCATGAAGAACT
GCTCCTTCAACATCACGACGGAGCTGCGCGACAAGCGCGAGAAGAAGAACGCCCTGTTCTACAAGCTGGACATCGTGCAGCTGGACGG
CAACTCCTCGCAGTACAGGCTGATCAACTGCAACACCTCCGTCATCACGCAGGCGTGCCCCAAGGTGTCCTTCGACCCCATCCCCATC
CACTACTGCGCCCCCGCCGGCTACGCCATCCTGAAGTGCAACAACAAGACCTTCACCGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTC
CGAGAACATCACGAACAACGGGAAGACCATCATCGTGCACCTGAACGAGTCCGTGAAGATCGAGTGCACCCGCCCGAACAACAAGACG
CGCACCTCCATCCGGATCGGCCCTGGCCAGGCCTTCTACGCCACCGGCCAGGTGATCGGCGACATCCGCGAGGCGCACTGCAACATCA
GCGAGTCCAAGTGGAACGAGACCCTGCAGCGCGTGTCCAAGAAGCTGAAGGAGTACTTCCCCCACCAGAACATCACCTTCCAGCCGTC
GTCCGGCGGCGACCTCGAGATCACCACGCACTCCTTCAACTGCGGTGGCGAGTTCTTCTACTGCAACACGTCGTCGCTGTTCAACCGC
ACCTACATGGCCAACTCCACCGACATGGCCAACTCCACCGAGACCAACTCCACGCGCACCATCACGATCCGCTGCCGCATCAAGCAGA
TCATCAACATGTGGCAGGAGGTGGGCCGCGCCATGTACGCACCGCCCATCGCCGGCAACATCACCTGCATCTCCAACATCACCGGCCT
CCTGCTGACCCGCGACGGCGGCAAGAACAACACGGACACGGAGACCTTCAGGCCAGGCGGAGGCAACATGAAGGACAACTGGCGCTCC
GAGCTGTACAAGTACAAGGTGGTGGAGGTGAAGCCCCTGGGCGTGGCACCCACCAACGCCCGCGAGCGCGTCGTGGAGCGCGAGAAGG
AGTAGTAAGggtcccgaattcggtaaccggatcc
>HV1300570_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCGACGAACGCCACCGCCTCCAACTCCTCCATCATCGAGGGCATGAAGAACTGCTCCT
TCAACATCACGACGGAGCTGCGCGACAAGCGCGAGAAGAAGAACGCCCTGTTCTACAAGCTGGACATCGTGCAGCTGGACGGCAACTC
CTCGCAGTACAGGCTGATCAACTGCAACACCTCCGTCATCACGCAGGCGTGCCCCAAGGTGTCCTTCGACCCCATCCCCATCCACTAC
TGCGCCCCCGCCGGCTACGCCATCCTGAAGTGCAACAACAAGACCTTCACCGGCACCGGCAGCTGCAACAACGTGTCCACCGTGCAGT
GCACGCACGGGATCAAGCCCGTGGTGTCCACGCAGCTGCTCCTGAACGGGTCGCTGGCCGAGGGCGAGATCATCATCCGGTCCGAGAA
CATCACGGACAACGGGAAGACCATCATCGTGCACCTGAACGAGTCCGTGAAGATCGAGTGCACCCGCCCGAACAACAAGACGCGCACC
TCCATCCGGATCGGCCCTGGCCAGGCCTTCTACGCCACCGGCCAGGTGATCGGCGACATCAAGGAGGCGTACTGCAACATCTCGGAGT
CCAAGTGGAACGAGACCCTGCAGCGCGTGTCCAAGAAGCTGAAGGAGTACTTCCCCCACAAGAACATCACCTTCCAGCCGTCGTCCGG
CGGCGACCTCGAGATCACCACGCACTCCTTCAACTGCGGTGGCGAGTTCTTCTACTGCAACACGTCGTCGCTGTTCAACCGCACCTAC
ATGGCCAACTCCACCGACATGGCCAACTCCACCGAGACCAACTCCACGCGCAACATCACGATCCACTGCCGCATCAAGCAGATCATCA
ACATGTGGCAGGAGGTGGGCCGCGCCATGTACGCACCGCCCATCGCCGGCAACATCACCTGCATCTCCAACATCACCGGCCTCCTGCT
GACCCGCGACGGCGGCAAGAACAACACGGACACGGAGACCTTCAGGCCAGGCGGAGGCAACATGAAGGACAACTGGCGCTCCGAGCTG

Fig. 16 (cont.)

```
TACAAGTACAAGGTGGTGGAGGTGAAGCCCCTGGGCGTGGCACCCACCAACGCCCGCGAGCGCGTCGTGGAGCGCGAGAAGGAGTAGT
AAGaggacccgaattcggtaaccggatcc
>HV1300571_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCGACGGCCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAA
CTCCTCGCAGTACAGGCTGATCAACTGCAACACCTCCGTCATCACGCAGGCGTGCCCCAAGGTGTCCTTCGACCCCATCCCCATCCAC
TACTGCGCCCCGCCGGCTACGCCATCCTGAAGTGCAACAACAAGACCTTCACCGGCACCGGCCCGTGCAACAACGTGTCCACCGTGC
AGTGCACGCACGGGATCAAGCCCGTGGTGTCCACGCAGCTGCTCCTGAACGGGTCGCTGGCCGAGGGCGAGATCATCATCCGGTCCGA
GAACATCACGAACAACGCGAAGACCATCATCGTGCACCTGAACGAGTCCGTGAAGATCGAGTGCACCCGCCCGAACAACAAGACGCGC
ACCTCCATCCGGATCGGCCCTGGCCAGGCCTTCTACGCCACCGGCCAGGTGATCGGCGACATCCGCGAGGCGTACTGCAACATCAGCG
AGTCCAAGTGGAACGAGACCCTGCAGCGCGTGTCCAAGAAGCTGAAGGAGTACTTCCCCCACAAGAACATCACCTTCCAGCCGTCGTC
CGGCGGCGACCTCGAGATCACCACGCACTCCTTCAACTGCGGTGGCGAGTTCTTCTACTGCAACACGTCGTCGCTGTTCAACCGCACC
TACATGGCCAACTCCACCGACATGGCCAACTCCACCGAGACCAACTCCACGCGCATCATCACGATCCACTGCCGCATCAAGCAGATCA
TCAACATGTGGCAGGAGGTGGGCCGCGCCATGTACGCACCGCCCATCGCCGGCAACATCACCTGCATCTCCAACATCACCGGCCTCCT
GCTGACCCGCGACGGCGGCAAGAACAACCCGGAGACCTTCAGGCCAGGCGGAGGCAACATGAAGGACAACTGGCGCTCCGAGCTGTAC
AAGTACAAGGTGGTGGAGGTGAAGCCCCTGGGCGTGGCACCCACCAACGCCCGCGAGCGCGTCGTGGAGCGCGAGAAGGAGTAGTAAG
aggtcccgaattcggtaaccggatcc
>HV1300572_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCGACGGCCCGGAACTGCACGAACGCCACCGCGTCCAACTCCTCCATCATCGAGGGCA
TGAAGAACTGCTCCTTCAACATCACGACGGAGCTGCGCGACAAGCGCGAGAAGAAGAACGCCCTGTTCTACAAGCTGGACATCGTGCA
GCTGGACGGCAACTCCTCGCAGTACAGGCTGATCAACTGCAACACCTCCGTCATCACGCAGGCGTGCCCCAAGGTGTCCTTCGACCCC
ATCCCCATCCACTACTGCGCCCCGCCGGCTACGCCATCCTGAAGTGCAACAACAAGACCTTCACCGGCACCGGCCCGTGCAACAACG
TGTCCACCGTGCAGTGCACGCACGGGATCAAGCCCGTGGTGTCCACGCAGCTGCTCCTGAACGGGTCGCTGGCCGAGGGCGAGATCAT
CATCCGGTCCGAGAACATCACGAACAGCGGGAAGACCATCATCGTGCACCTGAACGAGTCCGTGAAGATCGAGTGCACCCGCCCGAAC
AACAAGACGCGCACCTCCATCCGGATCGGCCCTGGCCAGGCCTTCTACGCCACCGGCCAGGTGATCGGCGACATCCGCGAGGCGTACT
GCAACATCTCGGAGTCCAAGTGGAACGAGACCCTGCAGCGCGTGTCCAAGAAGCTGAAGGAGTACTTCCCCCACAAGAACATCACCTT
CCAGCCGTCGTCCGGCGGCGACCTCGAGATCACCACGCACTCCTTCAACTGCGGTGGCGAGTTCTTCTACTGCAACACGTCGTCGCTG
TTCAACCGCACCTACATGGCCAACTCCACCGACATGGCCAACTCCACCGAGACCAACTCCACGCGCATCATCACGATCCACTGCCGCA
TCAAGCAGATCATCAACATGTGGCAGGAGGTGGGCCGCGCCATGTACGCACCGCCCATCGCCGGCAACATCACCTGCATCTCCAGCAT
CACCGGCCTCCTGCTGACCCGCGACGGCGGCGAGAACAACACGGAGACCTTCAGGCCAGGCGGAGGCAACATGAAGGACAACTGGCGC
TCCGAGCTGTACAAGTACAAGGTGGTGGAGGTGAAGCCCCTGGGCGTGGCACCCACCAACGCCCGCGAGCGCGTCGTGGAGCGCGAGA
AGGAGTAGTAAGggacctgaattcggtaaccggatcc
>HV1300573_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCGACGACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAA
CTCCTCGCAGTACAGGCTGATCAACTGCAACACCTCCGTCATCACGCAGGCGTGCCCCAAGGTGTCCTTCGACCCCATCCCCATCCAC
TACTGCGCCCCGCCGGCTACGCCATCCTGAAGTGCAACAACAAGACCTTCACCGGCACCGGCCCGTGCAACAACGTGTCCACCGTGC
AGTGCACGCACGGGATCAAGCCCGTGGTGTCCACGCAGCTGCTCCTGAACGGGTCGCTGGCCGAGGGCGAGATCATCATCCGGTCCGA
GAACATCACGAACAACGCGAAGACCATCATCGTGCACCTGAACGAGTCCGTGAAGATCGAGTGCACCCGCCCGAACAACAAGACGCGC
ACCTCCATCCGGATCGGCCCTGGCCAGGCCTTCTACGCCACCGGCCAGGTGATCGGCGACATCCGCGAGGCGTACTGCAACATCAGCG
AGTCCAAGTGGAACGAGACCCTGCAGCGCGTGTCCAAGAAGCTGAAGGAGTACTTCCCCCACAAGAACATCACCTTCCAGCCGTCGTC
CGGCGGCGACCTCGAGATCACCACGCACTCCTTCAACTGCGGTGGCGAGTTCTTCTACTGCAACACGTCGTCGCTGTTCAACCGCACC
TACATGGCCAACTCCACCGACATGGCCAACTCCACCGAGACCAACTCCACGCGCATCATCACGATCCACTGCCGCATCAAGCAGATCA
```

Fig. 16 (cont.)
```
TCAACATGTGGCAGGAGGTGGGCCGCGCCATGTACGCACCGCCCATCGCCGGCAACATCACCTGCATCTCCAACATCACCGGCCTCCT
GCTGACCCGCGACGGCGGCAAGAACACGAGGGACGGAGGCAAGAACAACACGGAGACCTTCAGGCCAGGCGGAGGCAACATGAAGGAC
AACTGGCGCTCCGAGCTGTACAAGTACAAGGTGGTGGAGGTGAAGCCCCTGGGCGTGGCACCCACCAACGCCCGCGAGCGCGTCGTGG
AGCGCGAGAAGGAGTAGTAAGggtcctgaattcggtaaccggatcc
>HV1300574_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCGACGACGAACGCCACCGCGTCCAACTCGTCCATCATCGAGGAGATGAAGAACTGCT
CCTTCAACATCACGACGGAGCTGCGCGACAAGCGCGAGAAGAAGAACGCCCTGTTCTACAAGCTGGACATCGTGCAGCTGGACGGCAA
CTCCTCGCAGTACAGGCTGATCAACTGCAACACCTCCGTCATCACGCAGGCGTGCCCCAAGGTGTCCTTCGACCCCATCCCCATCCAC
TACTGCGCCCCGCCGGCTACGCCATCCTGAAGTGCAACAACAAGACCTTCACCGGCACCGGCCCGTGCAACAACGTGTCCACCGTGC
AGTGCACGCACGGGATCAAGCCCGTGGTGTCCACGCAGCTGCTCCTGAACGGGTCGCTGGCCGAGGGCGAGATCATCATCCGGTCCGA
GAACATCACGAACACGGCGAAGACCATCATCGTGCACCTGAACGAGTCCGTGAAGATCGAGTGCACCCGCCCGAACAACAAGACGCGC
ACCTCCATCCGGATCGGCCCTGGCCAGGCCTTCTACGCCACCGGCCAGGTGATCGGCGACATCCGCGAGGCGTACTGCAACATCTCGG
AGTCCAAGTGGAACGAGACCCTGCAGCGCGTGTCCAAGAAGCTGAAGGAGTACTTCCCCCACAAGAACATCACCTTCCAGCCGTCGTC
CGGCGGCGACCTCGAGATCACCACGCACTCCTTCAACTGCGGTGGCGAGTTCTTCTACTGCAACACGTCGTCGCTGTTCAACCGCACC
TACATGGCCAACTCCACCGACATGGCCAACTCCACCGAGACCAACTCCACGCGCACCATCACGATCCGGTGCCGCATCAAGCAGATCA
TCAACATGTGGCAGGAGGTGGGCCGCGCCATGTACGCACCGCCCATCGCCGGCAACATCACCTGCATCTCCAACATCACCGGCCTCCT
GCTGACCCGCGACGGCGGCGAGAACAACACGGAGACCTTCAGGCCAGGCGGAGGCAACATGAAGGACAACTGGCGCTCCGAGCTGTAC
AAGTACAAGGTGGTGGAGGTGAAGCCCCTGGGCGTGGCACCCACCAACGCCCGCGAGCGCGTCGTGGAGCGCGAGAAGGAGTAGTAAG
ggtcccgaattcggttaccggatcc
>HV1300575_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCGACGGCCTCCAACGCCACCGCGTCCAACTCCTCCATCATCGAGGGCATGAAGAACT
GCTCCTTCAACATCACGACGGAGCTGCGCGACAAGCGCGAGAAGAAGAACGCCCTGTTCTACAAGCTGGACATCGTGCAGCTGGACGG
CAACTCCTCGCAGTACAGGCTGATCAACTGCAACACCTCCGTCATCACGCAGGCGTGCCCCAAGGTGTCCTTCGACCCCATCCCCATC
CACTACTGCGCCCCCGCCGGCTACGCCATCCTGAAGTGCAACAACAAGACCTTCACCGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTC
CGAGAACATCACGAACAACGGGAAGACCATCATCGTGCACCTGAACGAGTCCGTGAAGATCGAGTGCACCCGCCCGAGCAACAAGACG
CGCACCTCCATCCGGATCGGCCCTGGCCAGGCCTTCTACGCCACCGGCCAGGTGATCGGCGACATCCGCGAGGCGCACTGCAACATCT
CGGAGTCCAAGTGGAACGAGACCCTGCAGCGCGTGTCCAAGAAGCTGAAGGAGTACTTCCCCCACAAGAACATCACCTTCCAGCCGTC
GTCCGGCGGCGACCTCGAGATCACCACGCACTCCTTCAACTGCGGTGGCGAGTTCTTCTACTGCAACACGTCGTCGCTGTTCAACCGC
ACCTACATGGCCAACTCCACCGACATGGCCAACTCCACCGAGACCAACTCCACGCGCACCATCACGCTCCACTGCCGCATCAAGCAGA
TCATCAACATGTGGCAGGAGGTGGGCCGCGCCATGTACGCACCGCCCATCGCCGGCAACATCACCTGCATCTCCAACATCACCGGCCT
CCTGCTGACCCGCGACGGCGGCAAGAACAACACCGACACGGAGACCTTCAGGCCAGGCGGAGGCAACATGAAGGACAACTGGCGCTCC
GAGCTGTACAAGTACAAGGTGGTGGAGGTGAAGCCCCTGGGCGTGGCACCCACCAACGCCCGCGAGCGCGTCGTGGAGCGCGAGAAGG
AGTAGTAAGaggacccgaattcggttaccggatcc
>HV1300576_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCGACGACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAA
CTCCTCGCAGTACAGGCTGATCAACTGCAACACCTCCGTCATCACGCAGGCGTGCCCCAAGGTGTCCTTCGACCCCATCCCCATCCAC
TACTGCGCCCCGCCGGCTACGCCATCCTGAAGTGCAACAACAAGACCTTCACCGGCACCGGCCCGTGCAACAACGTGTCCACCGTGC
AGTGCACGCACGGGATCAAGCCCGTGGTGTCCACGCAGCTGCTCCTGAACGGGTCGCTGGCCGAGGGCGAGATCATCATCCGGTCCGA
GAACATCACGAACAACGCGAAGACCATCATCGTGCACCTGAACGAGTCCGTGAAGATCGAGTGCACCCGCCCGAACAACAAGACGCGC
ACCTCCATCCGGATCGGCCCTGGCCAGGCCTTCTACGCCACCGGCCAGGTGATCGGCGACATCCGCGAGGCGCACTGCAACATCAGCG
AGTCCAAGTGGAACGAGACCCTGCAGCGCGTGTCCAAGAAGCTGAAGGAGTACTTCCCCCACAAGAACATCACCTTCCAGCCGTCGTC
```

Fig. 16 (cont.)

CGGCGGCGACCTCGAGATCACCACGCACTCCTTCAACTGCGGTGGCGAGTTCTTCTACTGCAACACGTCGTCGCTGTTCAACCGCACC
TACATGGCCAACTCCACCGACATGGCCAACTCCACCGAGACCAACTCCACGCGCACCATCACGATCCGCTGCCGCATCAAGCAGATCA
TCAACATGTGGCAGGAGGTGGGCCGCGCCATGTACGCACCGCCCATCGCCGGCAACATCACCTGCATCTCCAACATCACCGGCCTCCT
GCTGACCCGCGACGGCGGCAAGAACAACACCGACACGGAGACCTTCAGGCCAGGCGGAGGCAACATGAAGGACAACTGGCGCTCCGAG
CTGTACAAGTACAAGGTGGTGGAGGTGAAGCCCCTGGGCGTGGCACCCACCAACGCCCGCGAGCGCGTCGTGGAGCGCGAGAAGGAGT
AGTAAGaggtcccgaattcggttaccggatcc
>HV1300577_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCGACGGCCAGCAACGCCACCGCGTCCAACTCCTCCATCATCGAGGGCATGAAGAACT
GCTCCTTCAACATCACGACGGAGCTGCGCGACAAGCGCGAGAAGAAGAACGCCCTGTTCTACAAGCTGGACATCGTGCAGCTGGACGG
CAACTCCTCGCAGTACAGGCTGATCAACTGCAACACCTCCGTCATCACGCAGGCGTGCCCCAAGGTGTCCTTCGACCCCATCCCCATC
CACTACTGCGCCCCCGCCGGCTACGCCATCCTGAAGTGCAACAACAAGACCTTCACCGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTC
CGAGAACATCACGAACAACGTGAAGACCATCATCGTGCACCTGAACGAGTCCGTGAAGATCGAGTGCACCCGCCCGAACAACAAGACG
CGCACCTCCATCCGGATCGGCCCTGGCCAGGCCTTCTACGCCACCGGCCAGGTGATCGGCAACATCCGCGAGGCGTACTGCAACATCT
CGGAGTCCAAGTGGAACGAGACCCTGCAGCGCGTGTCCAAGAAGCTGAAGGAGTACTTCCCCCACAAGAACATCACCTTCCAGCCGTC
GTCCGGCGGCGACCTCGAGATCACCACGCACTCCTTCAACTGCGGTGGCGAGTTCTTCTACTGCAACACGTCGTCGCTGTTCAACCGC
ACCTACATGGCCAACTCCACCGACATGGCCAACTCCACCGAGACCAACTCCACGCGCATCATCACGATCCACTGCCGCATCAAGCAGA
TCATCAACATGTGGCAGGAGGTGGGCCGCGCCATGTACGCACCGCCCATCGCCGGCAACATCACCTGCATCTCCAACATCACCGGCCT
CCTGCTGACCCGCGACGGCGGCAAGAACAACACCGACACGGAGACCTTCAGGCCAGGCGGAGGCAACATGAAGGACAACTGGCGCTCC
GAGCTGTACAAGTACAAGGTGGTGGAGGTGAAGCCCCTGGGCGTGGCACCCACCAACGCCCGCGAGCGCGTCGTGGAGCGCGAGAAGG
AGTAGTAAGggacctgaattcggttaccggatcc
>HV1300578_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGATGACC
CCGCTGTGCGTGACCCTGAACTGCACCAACGCCACCGCGATCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAACATCACGAA
CAACGACAAGACCATCATCGTGCACCTGAACGAGTCCGTGAAGATCGAGTGCACCCGCCCGAACAACAAGACGCGCACCTCCATCCGG
ATCGGCCCTGGCCAGGCCTTCTACGCCACCGGCCAGGTGATCGGCGACATCCGCGAGGCGCACTGCAACATCTCGGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCT
CGAGATCACCACGCACTCCTTCAACTGCGGTGGCGAGTTCTTCTACTGCAACACGTCGTCGCTGTTCAACCGCACCTACATGGCCAAC
TCCACCGACATGGCCAACTCCACCGAGACCAACTCCACGCGCACCATCACGATCCGCTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGA
CGGCGGCAAGAACAACACGGAGACCTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGggtcctgaattc
ggttaccggatcc
>HV1300579_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCGACGGCCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAA
CTCCTCGCAGTACAGGCTGATCAACTGCAACACCTCCGTCATCACGCAGGCGTGCCCCAAGGTGTCCTTCGACCCCATCCCCATCCAC
TACTGCGCCCCCGCCGGCTACGCCATCCTGAAGTGCAACAACAAGACCTTCAACGGCACCGGCCCGTGCAACAACGTGTCCACCGTGC
AGTGCACGCACGGGATCAAGCCCGTGGTGTCCACGCAGCTGCTCCTGAACGGGTCGCTGGCCGAGGGCGAGATCATCATCCGGTCCGA
GAACATCACGAACAACGTGAAGACCATCATCGTGCACCTGAACGAGTCCGTGAAGATCGAGTGCACCCGCCCGAACAACAAGACGCGC

Fig. 16 (cont.)

```
ACCTCCATCCGGATCGGCCCTGGCCAGGCCTTCTACGCCACCGGCCAGGTGATCGGCGACATCCGCGAGGCGTACTGCAACATCTCGG
AGTCCAAGTGGAACGAGACCCTGCAGCGCGTGTCCAAGAAGCTGAAGGAGTACTTCCCCCACAAGAACATCACCTTCCAGCCGTCGTC
CGGCGGCGACCTCGAGATCACCACGCACTCCTTCAACTGCGGTGGCGAGTTCTTCTACTGCAACACGTCGTCGCTGTTCAACCGCACC
TACATGGCCAACTCCACCGACATGGCCAACTCCACCGAGACCAACTCCACGCGCACCATCAAGATCCACTGCCGCATCAAGCAGATCA
TCAACATGTGGCAGGAGGTGGGCCGCGCCATGTACGCACCGCCCATCGCCGGCAACATCACCTGCATCTCCAACATCACCGGCCTCCT
GCTGACCCGCGACGGCGGCAAGAACAACACCGACACGGAGACCTTCAGGCCAGGCGGAGGCAACATGAAGGACAACTGGCGCTCCGAG
CTGTACAAGTACAAGGTGGTGGAGGTGAAGCCCCTGGGCGTGGCACCCACCAACGCCCGCGAGCGCGTCGTGGAGCGCGAGAAGGAGT
AGTAAGaattcggtgaccgggacccggatcc
>HV1300580_v2
gtgtcgacaagaagccaccATGCGCGTGATGGGCATCCAGCGCAACTACCCGCAGTGGTGGATCTGGTCGATGCTGGGCTTCTGGATG
CTCATGATCTGCAACGGCGTGCCGGTGTGGAAGGAGGCCAAGACGACCCTGTTCTGCGCGTCGGACGCCAAGGCCTACGAGAAGGAGG
TGCACAACGTGTGGGCGACCCACGCCTGCGTGCCCACGGACCCCAACCCGCAGGAGATGGTGCTGAAGAACGTGACCGAGAACTTCAA
CATGTGGAAGAACGACATGGTGGACCAGATGCACGAGGACGTGATCTCCCTGTGGGACCAGTCCCTGAAGCCCTGCGTGAAGCTGACC
CCGCTGTGCGTGACCCTGAACTGCACCAACGCGACGAACGCCACCGCGTCCAACTCCTCCATCCTCGAGGGCATGAAGAACTGCTCCT
TCAACATCACGACGGAGCTGCGCGACAAGCGCGAGAAGAAGAACGCCCTGTTCTACAAGCTGGACATCGTGCAGCTGGACGGCAACTC
CTCGCAGTACAGGCTGATCAACTGCAACACCTCCGTCATCACGCAGGCGTGCCCCAAGGTGTCCTTCGACCCCATCCCCATCCACTAC
TGCGCCCCGCCGGCTACGCCATCCTGAAGTGCAACAACAAGACCTTCAACGGCACCGGCCCGTGCAACAACGTGTCCACCGTGCAGT
GCACGCACGGGATCAAGCCCGTGGTGTCCACGCAGCTGCTCCTGAACGGGTCGCTGGCCGAGGGCGAGATCATCATCCGGTCCGAGAA
CATCACGGACAACGGGAAGACCATCATCGTGCACCTGAACGAGTCCGTGAAGATCGAGTGCACCCGCCCGAGCAACAACACGCGCACC
TCCATCCGGATCGGCCCTGGCCAGGCCTTCTACGCCACCGGCCAGGTGATCGGCGACATCCGCGAGGCGCACTGCAACATCTCGGAGT
CCAAGTGGAACGAGACCCTGCAGCGCGTGTCCAAGAAGCTGAAGGAGTACTTCCCCCACAAGAACATCACCTTCCAGCCGTCGTCCGG
CGGCGACCTCGAGATCACCACGCACTCCTTCAACTGCGGTGGCGAGTTCTTCTACTGCAACACGTCGTCGCTGTTCAACCGCACCTAC
ATGGCCAACTCCACCGAGACCAACTCCACGCGCACCATCACGCTCCACTGCCGCATCAAGCAGATCATCAACATGTGGCAGGAGGTGG
GCCGCGCCATGTACGCACCGCCCATCGCCGGCAACATCACCTGCATCTCCAACATCACCGGCCTCCTGCTGACCCGCGACGGCGGCAA
GAACAACACGGAGACCTTCGAGACGTTCAGGCCAGGCGGAGGCAACATGAAGGACAACTGGCGCTCCGAGCTGTACAAGTACAAGGTG
GTGGAGGTGAAGCCCCTGGGCGTGGCACCCACCAACGCCCGCGAGCGCGTCGTGGAGCGCGAGAAGGAGTAGTAAGaattcggtcacc
gggacccggatcc
>HV1300581
gtcgacaagaagccaccATGCGCGTGATGGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACCAACGCGACGAACGCCACCGCGTCCAACTCCTCCATCCTCGAGGGCATGAAGAACTGCTCCTTC
AACATCACGACGGAGCTGCGCGACAAGCGCGAGAAGAAGAACGCCCTGTTCTACAAGCTGGACATCGTGCAGCTGGACGGCAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCCGAGAACA
TCACGGACAACGGGAAGACCATCATCGTGCACCTGAACGAGTCCGTGAAGATCGAGTGCACCCGCCCGTCGAACAACACGCGCACCTC
CATCCGGATCGGCCCTGGCCAGGCCTTCTACGCCACCGGCCAGGTGATCGGCGACATCCGCGAGGCGCACTGCAACATCTCGGAGTCC
AAGTGGAACGAGACCCTGCAGCGCGTGTCCAAGAAGCTGAAGGAGTACTTCCCCCACAAGAACATCACCTTCCAGCCGTCGTCCGGCG
GCGACCTCGAGATCACCACGCACTCCTTCAACTGCGGTGGCGAGTTCTTCTACTGCAACACGTCGTCGCTGTTCAACCGCACCTACAT
GGCCAACTCCACCGAGACCAACTCCACGCGCACCATCACGATCCGCTGCCGCATCAAGCAGATCATCAACATGTGGCAGGAGGTGGGC
CGCGCCATGTACGCACCGCCCATCGCCGGCAACATCACCTGCATCTCCAACATCACCGGCCTCCTGCTGACCCGCGACGGCGGCGAGA
ACAACACGGAGACCTTCGAGACGTTCAGGCCAGGCGGAGGCAACATGAAGGACAACTGGCGCTCCGAGCTGTACAAGTACAAGGTGGT
GGAGGTGAAGCCCCTGGGCGTGGCACCCACCAACGCCcgcGAGcgcgcggtggagcgcgagaagGAGTAGTAAGaattcggtaaccgg
gacccggatcc
>HV1300582
gtcgacaagaagccaccATGCGCGTGATGGGCCGCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACCGACGCGTCCAACGCCGAACTCGTCTATCATCGAGGGGATGAACTCCTCC
ATCATCGAGGGCATGAAGAACTGCTCCTTCAACATCACGACGGAGCTGCGCGACAAGCGCGAGAAGAAGAACGCCCTGTTCTACAAGC
TGGACATCGTGCAGCTGGACGGCAACTCCTCGCAGTACAGGCTGATCAACTGCAACACCTCCGTCATCACGCAGGCGTGCCCCAAGGT
GTCCTTCGACCCCATCCCCATCCACTACTGCGCCCCGCCGGCTACGCCATCCTGAAGTGCAACAACAAGACCTTCAACGGCACCGGC
```

Fig. 16 (cont.)
CCGTGCAACAACGTGTCCACCGTGCAGTGCACGCACGGGATCAAGCCCGTGGTGTCCACGCAGCTGCTCCTGAACGGGTCGCTGGCCG
AGGGCGAGATCATCATCCGGTCCGAGAACATCACGGACAACGGGAAGACCATCATCGTGCACCTGAACGAGTCCGTGAAGATCGAGTG
CACCCGCCCGTCGAACAACACGCGCACCTCCATCCGGATCGGCCCTGGCCAGGCCTTCTACGCCACCGGCCAGGTGATCGGCGACATC
CGCGAGGCGCACTGCAACATCTCGGAGTCCAAGTGGAACGAGACCCTGCAGCGCGTGTCCGAGAAGCTGAAGGAGTACTTCCCCCACA
AGAACATCACCTTCCAGCCGTCGTCCGGCGGCGACCTCGAGATCACCACGCACTCCTTCAACTGCGGTGGCGAGTTCTTCTACTGCAA
CACGTCGTCGCTGTTCAACCGCACCTACATGGCCACGAGCACCGACATGGCCAACTCCACCGAGACCAACTCCACGCGCATCATCACG
ATCCGGTGCCGCATCAAGCAGATCATCAACATGTGGCAGGAGGTGGGCCGCGCCATGTACGCACCGCCCATCGCCGGCAACATCACCT
GCATCTCCAACATCACCGGCCTCCTGCTGACCCGCGACGGCGGCAAGAACAACACGGAGACCTTCGAGACGTTCAGGCCAGGCGGAGG
CAACATGAAGGACAACTGGCGCTCCGAGCTGTACAAGTACAAGGTGGTGGAGGTGAAGCCCCTGGGCGTGGCACCCACCAACGCCCGC
GAGCGCGTCGTGGAGCGCGAGAAGGAGTAGTAAGaattcggttaccgggacccggatcc
>HV1300583
gtcgacaagaagccaccATGCGCGTGATGGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACCAACGCGAACGCCACCGCGTCCAACTCCTCTATCATCGAGGGGATGAACTCCTCCATCATCGAG
GGCATGAAGAACTGCTCCTTCAACATCACGACGGAGCTGCGCGACAAGCGCGAGAAGAAGAACGCCCTGTTCTACAAGCTGGACATCG
TGCAGCTGGACGGCAACTCCTCGCAGTACAGGCTGATCAACTGCAACACCTCCGTCATCACGCAGGCGTGCCCCAAGGTGTCCTTCGA
CCCCATCCCCATCCACTACTGCGCCCCCGCCGGCTACGCCATCCTGAAGTGCAACAACAAGACCTTCAACGGCACCGGCCCGTGCAAC
AACGTGTCCACCGTGCAGTGCACGCACGGGATCAAGCCCGTGGTGTCCACGCAGCTGCTCCTGAACGGGTCGCTGGCCGAGGGCGAGA
TCATCATCCGGTCCGAGAACATCACGGACAACGGGAAGACCATCATCGTGCACCTGAACGAGTCCGTGAAGATCGAGTGCACCCGCCC
GAGCAACAACACGCGCACCTCCATCCGGATCGGCCCTGGCCAGGCCTTCTACGCCACCGGCCAGGTGATCGGCGACATCCGCGAGGCG
CACTGCAACATCTCGGAGTCCAAGTGGAACGAGACCCTGCAGCGCGTGTCCGAGAAGCTGAAGGAGTACTTCCCCCACAAGAACATCA
CCTTCCAGCCGTCGTCCGGCGGCGACCTCGAGATCACCACGCACTCCTTCAACTGCGGTGGCGAGTTCTTCTACTGCAACACGTCGTC
GCTGTTCAACCGCACCTACATGGCCCACGTCCACCGACATGGCCAACTCCACCGAGACCAACTCCACGCGCATCATCACGATCCGGTGC
CGCATCAAGCAGATCATCAACATGTGGCAGGAGGTGGGCCGCGCCATGTACGCACCGCCCATCGCCGGCAACATCACCTGCATCTCCA
ACATCACCGGCCTCCTGCTGACCCGCGACGGCGGCAAGAACAACACGGAGACCTTCGAGACGTTCAGGCCAGGCGGAGGCAACATGAA
GGACAACTGGCGCTCCGAGCTGTACAAGTACAAGGTGGTGGAGGTGAAGCCCCTGGGCGTGGCACCCACCAACGCCCGCGAGCGCGTC
GTGGAGCGCGAGAAGGAGTAGTAAGaattcggtgaccgggtcccggatcc
>HV1300584
gtcgacaagaagccaccATGCGCGTGATGGGCATCCAGCGCAACTACCCGCAGTGGTGGATCTGGTCGATGCTGGGCCTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGGAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACCGACGCCACCGCGTCCAACGCAACCGCGAGCAACGCCACGGCGTCGAACTCCTCCATCATCGAG
GGCATGAAGAACTGCTCCTTCAACATCACGACGGAGCTGCGCGACAAGCGCGAGAAGAAGAACGCCCTGTTCTACAAGCTGGACATCG
TGCAGCTGGACGGCAACTCCTCGCAGTACAGGCTGATCAACTGCAACACCTCCGTCATCACGCAGGCGTGCCCCAAGGTGTCCTTCGA
CCCCATCCCCATCCACTACTGCGCCCCCGCCGGCTACGCCATCCTGAAGTGCAACAACAAGACCTTCAACGGCACCGGCCCGTGCAAC
AACGTGTCCACCGTGCAGTGCACGCACGGGATCAAGCCCGTGGTGTCCACGCAGCTGCTCCTGAACGGGTCGCTGGCCGAGGGCGAGA
TCATCATCCGGTCCGAGAACATCACGGACAACGGGAAGACCATCATCGTGCACCTGAACGAGTCCGTGAAGATCGAGTGCACCCGCCC
GAGCAACAACACGCGCACCTCCATCCGGATCGGCCCTGGCCAGGCCTTCTACGCCACCGGCCAGGTGATCGGCGACATCCGCGAGGCG
CACTGCAACATCTCGGAGAACAAGTGGAACGAGACCCTGCAGCGCGTGTCCAAGAAGCTGAAGGAGTACTTCCCCCACAAGAACATCA
CCTTCCAGCCGTCGTCCGGCGGCGACCTCGAGATCACCACGCACTCCTTCAACTGCGGTGGCGAGTTCTTCTACTGCAACACGTCGTC
GCTGTTCAACCGCACCTACATGGCCAACTCCACCGACATGGCCAACTCCACCGAGACCAACTCCACGCGCACCATCACGATCCGCTGC
CGCATCAAGCAGATCATCAACATGTGGCAGGAGGTGGGCCGCGCCATGTACGCACCGCCCATCGCCGGCAACATCACCTGCATCTCCA
ACATCACCGGCCTCCTGCTGACCCGCGACGGCGGCAAGAACAACACGGAGACCTTCGAGACGTTCAGGCCAGGCGGAGGCAACATGAA
GGACAACTGGCGCTCCGAGCTGTACAAGTACAAGGTGGTGGAGGTGAAGCCCCTGGGCGTGGCACCCACCAACGCCCGCGAGCGCGTC
GTGGAGCGCGAGAAGGAGTAGTAAGaattcggtgaccaggacccggatcc
>HV1300585
gtcgacaagaagccaccATGCGCGTGATGGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACCGACGCCACCGCGTCCAACGCGATCAACTCCTCCATCATCGAGGGCATGAAGAACTGC
TCCTTCAACATCACGACGGAGCTGCGCGACAAGCGCGAGAAGAAGAACGCCCTGTTCTACAAGCTGGACATCGTGCAGCTGGACGGCA Fig. 16 (cont.)
ACTCCTCGCAGTACAGGCTGATCAACTGCAACACCTCCGTCATCACGCAGGCGTGCCCCAAGGTGTCCTTCGACCCCATCCCCATCCA
CTACTGCGCCCCCGCCGGCTACGCCATCCTGAAGTGCAACAACAAGACCTTCAACGGCACCGGCCCGTGCAACAACGTGTCCACCGTG
CAGTGCACGCACGGGATCAAGCCCGTGGTGTCCACGCAGCTGCTCCTGAACGGGTCGCTGGCCGAGGGCGAGATCATCATCCGGTCCG
AGAACATCACGAACAACGCGAAGACCATCATCGTGCACCTGAACGAGTCCGTGAAGATCGAGTGCACCCGCCCGTCGAACAACACGCG
CACCTCCATCCGGATCGGCCCTGGCCAGGCCTTCTACGCCACCGGCCAGGTGATCGGCGACATCCGCGAGGCGCACTGCAACATCTCG
GAGTCCAAGTGGAACGAGACCCTGCAGCGCGTGTCCAAGAAGCTGAAGGAGTACTTCCCCCACAAGAACATCACCTTCCAGCCGTCGT
CCGGCGGCGACCTCGAGATCACCACGCACTCCTTCAACTGCGGTGGCGAGTTCTTCTACTGCAACACGTCGTCGCTGTTCAACCGCAC
CTACATGGCCAACTCCACCGAGACCAACTCCACGCGCATCATCACGATCCGCTGCCGCATCAAGCAGATCATCAACATGTGGCAGGAG
GTGGGCCGCGCCATGTACGCACCGCCCATCGCCGGCAACATCACCTGCATCTCCAACATCACCGGCCTCCTGCTGACCCGCGACGGCG
GCAAGAACAACACGGAGACCTTCGAGACGTTCAGGCCAGAGGGAGGCAACATGAAGGACAACTGGCGCTCCGAGCTGTACAAGTACAA
GGTGGTGGAGGTGAAGCCCCTGGGCGTGGCACCCACCAACGCCCGCGAGCGCGTCGTGGAGCGCGAGAAGGAGTAGTAAGaattcggt
gaccaggtcccggatcc
>HV1300586
gtcgacaagaagccaccATGCGCGTGATGGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACCGACGCCACCGCGTCCAACGCAACCGCGAGCAACGCCACGGCGTCGAACTCCTCCATCATCGAG
GGCATGAAGAACTGCTCCTTCAACATCACGACGGAGCTGCGCGACAAGCGCGAGAAGAAGAACGCCCTGTTCTACAAGCTGGACATCG
TGCAGCTGGACGGCAACTCCTCGCAGTACAGGCTGATCAACTGCAACACCTCCGTCATCACGCAGGCGTGCCCCAAGGTGTCCTTCGA
CCCCATCCCCATCCACTACTGCGCCCCCGCCGGCTACGCCATCCTGAAGTGCAACAACAAGACCTTCAACGGCACCGGCCCGTGCAAC
AACGTGTCCACCGTGCAGTGCACGCACGGGATCAAGCCCGTGGTGTCCACGCAGCTGCTCCTGAACGGGTCGCTGGCCGAGGGCGAGA
TCATCATCCGGTCCGAGAACATCACGAACAACGGGAAGACCATCATCGTGCACCTGAACGAGTCCGTGAAGATCGAGTGCACCCGCCC
GTCGAACAACACGCGCACCTCCATCCGGATCGGCCCTGGCCAGGCCTTCTACGCCACCGGCCAGGTGATCGGCGACATCCGCGAGGCG
CACTGCAACATCTCGGAGTCCAAGTGGAACGAGACCCTGCAGCGCGTGTCCAAGAAGCTGAAGGAGTACTTCCCCCACAAGAACATCA
CCTTCCAGCCGTCGTCCGGCGGCGACCTCGAGATCACCACGCACTCCTTCAACTGCGGTGGCGAGTTCTTCTACTGCAACACGTCGTC
GCTGTTCAACCGCACCTACATGGCCAACTCCACCGAGACCAACTCCACGCGCATCATCACGATCCGCTGCCGCATCAAGCAGATCATC
AACATGTGGCAGGAGGTGGGCCGCGCCATGTACGCACCGCCCATCGCCGGCAACATCACCTGCATCTCCAACATCACCGGCCTCCTGC
TGACCCGCGACGGCGGCAACAACAACACGGAGACCTTCAGGCCAGGCGGAGGCAACATGAAGGACAACTGGCGCTCCGAGCTGTACAA
GTACAAGGTGGTGGAGGTGAAGCCCCTGGGCGTGGCACCCACCAACGCCCGCGAGCGCGTCGTGGAGCGCGAGAAGGAGTAGTAAGaa
ttcggtgaccgggacctggatcc
>HV1300587
gtcgacaagaagccaccATGCGCGTGATGGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAGGCTGACCCC
GCTGTGCGTGACCCTGAACTGCATCAAGCCACCAACGCAACCGCGTCCAACAACTCCATCCTCGAGGGCATGAAGAACTGCTCCTTC
AACATCGCGACGGAGCTGCGCGACAAGCGCGAGAAGAAGAACGCCCTGTTCTACAAGCTGGACATCGTGCAGCTGGACGGCAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACCGACAACGGGAAGACCATCATCGTGCACCTGAACGAGTCCGTGAAGATCGAGTGCACCCGCCCGTCGAACAACACGCGCACCTC
CATCCGGATCGGCCCTGGCCAGGCCTTCTACGCCACCGGCCAGGTGATCGGCAACATCCGCGAGGCGCACTGCAACATCTCGGAGTCC
AAGTGGAACGAGACCCTGCAGCGCGTGTCCAAGAAGCTGAAGGAGTACTTCCCCGACAAGAACATCACGTTCCAGCCGTCGTCCGGCG
GCGACCTCGAGATCACCACGCACTCCTTCAGCTGCGGTGGCGAGTTCTTCTACTGCAACACGTCGTCGCTGTTCAACCGCACCTACAT
GGCCACGAACACCGACATGGCCAACTCCACCGAGACCAACTCCACGCGCATCATCACGATCCGCTGCCGCATCCGGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCGAGAACAACACGGAGACCTTCGAGACGTTCAGGCCAGGCGGAGGCAACATGAAGGACAACTGGCGCTCCGAGCT
GTACAAGTACAAGGTGGTGGAGGTGAAGCCCCTGGGCGTGGCACCCACCAACGCCCGCGAGCGCGTCGTGGAGCGCGAGAAGGAGT**AG
TAAG**aattcggtgaccgggtcctggatcc
>HV1300588
gtcgacaagaagccaccATGCGCGTGATGGGCATCCAGCGCAACTACCCGCAGTGGTGGATCTGGTCGATGCTGGGCCTGTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGCGGACCAGATGCACGAGGACGTGATCTCCCTGTGGGACCAGTCCCTGAAGCCCTGCGTGAAGCTGACCCC Fig. 16 (cont.)
GCTGTGCGTGACCCTGAACTGCACCGACGCCACCGCGTCCAACGCAACCGCGAGCAACGCCACGGCGTCGAACTCGTCCATCAACAGC
TCCATCATCGAGGAGATGAAGAACTGCTCCTTCAACATCACGACGGAGCTGCGCGACAAGCGCGAGAAGAAGAACGCCCTGTTCTACA
AGCTGGACATCGTGCAGCTGGACGGCAACTCCTCGCAGTACAGGCTGATCAACTGCAACACCTCCGCGATCACGCAGGCGTGCCCCAA
GGTGTCCTTCGACCCCATCCCCATCCACTACTGCGCCCCCGCCGGCTACGCCATCCTGAAGTGCAACAACAAGACCTTCAACGGCACC
GGCCCGTGCAACAACGTGTCCACCGTGCAGTGCACGCACGGGATCAAGCCCGTGGTGTCCACGCAGCTGCTCCTGAACGGGTCGCTGG
CCGAGGGCGAGATCATCATCCGGTCCGAGAACATCACGGACAACGGGAAGACCATCATCGTGCACCTGAACGAGTCCGTGAAGATCGA
GTGCACCCGCCCGAGCAACAACACGCGCACCTCCATCCGGATCGGCCCTGGCCAGGCCTTCTACGCCACCGGCCAGGTGATCGGCGAC
ATCCGCGAGGCGCACTGCAACATCTCGGAGTCCAAGTGGAACGAGACCCTGCAGCGCGTGTCCAAGAAGCTGAAGGAGTACTTCCCCC
ACAAGAACATCACCTTCCAGCCGTCGTCCGGCGGCGACCTCGAGGTCACGACGCACTCCTTCAACTGCGGTGGCGAGTTCTTCTACTG
CAACACGTCGTCGCTGTTCAACCGCACCGACATGGCCAACTCCACCGAGACCAACTCCACGCGCATCATCACCATCCGCTGCCGCATC
AAGCAGATCGTCAACATGTGGCAGGAGGTGGGCCGCGCCATGTACGCACCGCCCATCGCCGGCAACATCACCTGCATCTCCAACATCA
CCGGCCTCCTGCTGACCCGCGACGGCGGCGAGAACAACGGCGGGAAGAACAACACGGAGACCTTCAGGCCAGGCGGAGGCAACATGAA
GGACAACTGGCGCTCCGAGCTGTACAAGTACAAGGTGGTGGAGGTGAAGCCCCTGGGCGTGGCACCCACCAACGCCCGCGAGCGCGTC
GTGGAGCGCGAGAAGGAGTAGTAAGaattcggtcaccgggtcccggatcc
>HV1300589
gtcgacaagaagccaccATGCGCGTGATGGGCATCCAGCGCAACTACACGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACCAACGTGAACGCCACCGCGTCCAACTCCTCTATCATCGAGGGGATGAACTCGTCCATCCTCGAG
GGCATGAAGAACTGCTCCTTCAACATCACGACGGAGCTGCGCGACAAGCGCGAGAAGAAGAACGCCCTGTTCTACAAGCTGGACATCG
TGCAGCTGGGGGGCAACTCCTCGCAGTACAGGCTGATCAACTGCAACACCTCCGTCATCACGCAGGCGTGCCCCAAGGTGTCCTTCGA
CCCCATCCCCATCCACTACTGCGCCCCCGCCGGCTACGCCATCCTGAAGTGCAACAACAAGACCTTCAACGGCACCGGCCCGTGCAAC
AACGTGTCCACCGTGCAGTGCACGCACGGGATCAAGCCCGTGGTGTCCACGCAGCTGCTCCTGAACGGGTCGCTGGCCGAGGGCGAGA
TCATCATCCGGTCGAAGAACATCACGGACAACGGGAAGACCATCATCGTGCACCTGAACGAGTCCGTGAAGATCGAGTGCACCCGCCC
GTCGAACAACACGCGCACCTCCATCCGGATCGGCCCTGGCCAGGCCTTCTACGCCACCGGCCAGGTGATCGGCGACATCCGCGAGGCG
CACTGCAACATCAGCGAGTCCAAGTGGAACGAGACCCTGCAGCGCGTGTCCGAGAAGCTGAAGGAGTACTTCCCCGACAAGAACATCA
CCTTCCAGCCGTCGTCCGGCGGCGACCTCGAGATCACCACGCACTCCTTCAACTGCGGTGGCGAGTTCTTCTACTGCAACACGTCGTC
GCTGTTCAACCGCACCTACATGGCCAACTCCACCGACATGGCCAACTCCACCGAGACCAACTCCACGCGCATCATCACGATCCGCTGC
CGCATCAAGCAGATCATCAACATGTGGCAGGAGGTGGGCCGCGCCATGTACGCACCGCCCATCGCCGGCAACATCACCTGCATCTCCA
ACATCACCGGCCTCCTGCTGACCCGCGACGGCGGCGAGAACAACACGGAGACCTTCGAGACGTTCAGGCCAGGCGGAGGCAACATGAA
GGACAACTGGCGCTCCGAGCTGTACAAGTACAAGGTGGTGGAGGTGAAGCCCCTGGGCGTGGCACCCACCAACGCCCGCGAGCGCGTC
GTGGAGCGCGAGAAGGAGTAGTAAGaattcggtcaccaggacccggatcc
>HV1300590
gtcgacaagaagccaccATGCGCGTGATGGGCATCCAGCGCAACTACCCGCAGTGGTGGATCTGGTCGATGCTGGGCCTGTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACCGACGCCACCGCGTCCAACGCAACCGCGAGCAACGCCACGGCGTCGAACGCGACCGCGTCGAAC
TCCTCCATCATCATCGAGGGCATGAAGAACTGCTCCTTCAACATCACGACGGAGCTGCGCGACAAGCGCGAGAAGAAGAACGCCCTGT
TCTACAAGCTGGACATCGTGCAGCTGGACGGCAACTCCTCGCAGTACAGGCTGATCAACTGCAACACCTCCGTCATCACGCAGGCGTG
CCCCAAGGTGTCCTTCGACCCCATCCCCATCCACTACTGCGCCCCCGCCGGCTACGCCATCCTGAAGTGCAACAACAAGACCTTCAAC
GGCACCGGCCCGTGCAACAACGTGTCCACCGTGCAGTGCACGCACGGGATCAAGCCCGTGGTGTCCACGCAGCTGCTCCTGAACGGGT
CGCTGGCCGAGGGCGAGATCATCATCCGGTCCAAGAACATCACGGACAACGGGAAGACCATCATCGTGCACCTGAACGAGTCCGTGAA
GATCGAGTGCACCCGCCCGAGCAACAACACGCGCACCTCCATCCGGATCGGCCCTGGCCAGGCCTTCTACGCCACCGGCCAGGTGATC
GGCGACATCCGCGAGGCGCACTGCAACATCAGCGAGTCCAAGTGGAACGAGACCCTGCAGCGCGTGTCCAAGAAGCTGAAGGAGTACT
TCCCCCAGAAGAACATCACCTTCCAGCCGTCGTCCGGCGGCGACCTCGAGATCACCACGCACTCCTTCAACTGCGGTGGCGAGTTCTT
CTACTGCAACACGTCGTCGCTGTTCAACCGCACCTACATGGCCAACTCCACCGACATGGCCAACTCCACCGAGACCAACCGCACCATC
ACGATCCGCTGCCGCATCAAGCAGATCATCAACATGTGGCAGGAGGTGGGCCGCGCCATGTACGCACCGCCCATCGCCGGCAACATCA
CCTGCATCTCCAACATCACCGGCCTCCTGCTGACCCGCGACGGCGGCAAGAACAACACGGAGACCTTCGAGACGTTCAGGCCAGGCGG
AGGCAACATGAAGGACAACTGGCGCTCCGAGCTGTACAAGTACAAGGTGGTGGAGGTGAAGCCCCTGGGCGTGGCACCCACCAACGCC
CGCGAGCGCGTCGTGGAGCGCGAGAAGGAGTAGTAAGaattcggtcaccaggtcccggatcc
>HV1300591
gtcgacaagaagccaccATGCGCGTGATGGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG

Fig. 16 (cont.)

```
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCATCGACGCCACCGCGTCCAACGCGACGGCGATCAACATCTCCATCATCGAGGAGATGAAGAACTGC
TCCTTCAACATCACGACGGAGCTGCGCGACAAGCGCGAGAAGAAGAACGCCCTGTTCTACAAGCTGGACATCGTGCAGCTGGACGGCA
ACTCCTCGCAGCACAGGCTGATCAACTGCAACACCTCCGTCATCACGCAGGCGTGCCCCAAGGTGTCCTTCGACCCCATCCCCATCCA
CTACTGCGCCCCGCCGGCTACGCCATCCTGAAGTGCAACAACAAGACCTTCAACGGCACCGGCCCGTGCAACAACGTGTCCACCGTG
CAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACGGGAAGACCATCATCGTGCACCTGAACGAGTCCGTGAAGATCGAGTGCACCCGCCCGAGCAACAACACGCG
CACCTCCATCCGGATCGGCCCTGGCCAGGCCTTCTACGCCACCGGCCAGGTGATCGGCAACATCCGCGAGGCGCACTGCAACATCTCC
GAGTCCAAGTGGAACGAGACCCTGCAGCGCGTGTCCGAGAAGCTGAAGGAGTACTTCCCCCACAAGAACATCACCTTCCAGCCGTCGT
CCGGCGGCGACCTCGAGATCACCACGCACTCCTTCAACTGCGGTGGCGAGTTCTTCTACTGCAACACGTCGTCGCTGTTCAACCGCAC
CTACATGGCCACCTCCACCGACATGGCCAACTCCACCGAGACCAACTCCACGCGCATCATCACGATCCGCTGCCGCATCAAGCAGATC
ATCAACATGTGGCAGGAGGTGGGCCGCGCCATGTACGCACCGCCCATCGCCGGCAACATCACCTGCATCTCCAACATCACCGGCCTCC
TGCTGACCCGCGACGGCGGCAAGAACGACACCGACACGGAGACCTTCAGGCCAGAGGGAGGCAACATGAAGGACAACTGGCGCTCCGA
GCTGTACAAGTACAAGGTGGTGGAGGTGAAGCCCCTGGGCGTGGCACCCACCAACGCCCGCGAGCGCGTCGTGGAGCGCGAGAAGGAG
TAGTAAGaattcggtcaccgggacctggatcc
>HV1300592
gtcgacaagaagccaccATGCGCGTGATGGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAGCTGCACGAACGCCACCAACGCGACGGCGTCGAACTCGTCCATCCTCGAGGGGATGAAGAACTGCTCCTTC
AACATCACGACGGAGCTGCGCGACAAGCGCGAGAAGAAGAACGCCCTGTTCTACAAGCTGGACATCGTGCAGCTGGACGGCAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCGCCGGCTACGCCATCCTGAAGTGCAACAACAAGACCTTCAACGGCACCGGCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACGGGAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCGACATCCGCGAGGCGCACTGCAACATCTCCGAGTCC
AAGTGGAACGAGACCCTGCAGCGCGTGTCCGAGAAGCTGAAGGAGTACTTCCCCCACAAGAACATCACCTTCCAGCCGTCGTCCGGCG
GCGACCTCGAGATCACCACGCACTCCTTCAACTGCGGTGGCGAGTTCTTCTACTGCAACACGTCGTCGCTGTTCAACCGCACCTACAT
GGCCACCTCCACCGACATGGCCAACTCCACCGAGACCAACTCCACGCGCATCATCACGATCCGCTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAAGAACGACACGGACACCTTCAGGCCAGAGGGAGGCAACATGAAGGACAACTGGCGCTCCGAGCTGTACAAGTA
CAAGGTGGTGGAGGTGAAGCCCCTGGGCGTGGCACCCACCAACGCCCGCGAGCGCGTCGTGGAGCGCGAGAAGGAGTAGTAAGaattc
ggtcaccgggtcctggatcc
>HV1300593
gtcgacaagaagccaccATGCGCGTGATGGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGGACTGCATCAACGCCACCAACGCGACGGCGTCGAACTCCTCCATCCTCGAGGGGATGAAGAACTGCTCCTTC
AACATCACGACGGAGCTGCGCGACAAGCGCGAGAAGAAGAACGCCCTGTTCTACAAGCTGGACATCGTGCAGCTGGGGGGCAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACGGGAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCGACATCCGCGAGGCGCACTGCAACATCTCCGAGTCC
AAGTGGAACGAGACCCTGCAGCGCGTGTCCAAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGTGAACTCCACCGACATGGCCAACTCCACCGAGACCAACTCCACGCGCACCATCACGATCCGCTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCGAGAACAACACCGAGACGTTCGAGACCTTCAGGCCAGGGGAGGCAACATGAAGGACAACTGGCGCTCCGAGCT
GTACAAGTACAAGGTGGTGGAGGTGAAGCCCCTGGGCGTGGCACCCACCAACGCCCGCGAGCGCGTCGTGGAGCGCGAGAAGGAGTAG
TAAGaattcggtaaccgggtcccggatcc
>HV1300594
```

Fig. 16 (cont.)
gtcgacaagaagccaccATGCGCGTGATGGGCCGCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGACGCCCTGCGTGAAGCTGACCCC
GCTGTGCGTGACCCTGAACTGCACCGACGCCACCGCATCCAACGCGACGGCTTCCAACGCCACGGCGTCGAACGCGACAGCGTCGAAC
TCGTCTATCGAGGGGATGAAGAACTGCTCCTTCAACATCACGACGGAGCTGCGCGACAAGCGCGAGAAGAAGAACGCCCTGTTCTACA
AGCTGGACATCGTGCAGCTGGACGGCAACTCCTCGCAGTACAGGCTGATCAACTGCAACACCTCCGTCATCACGCAGGCGTGCCCCAA
GGTGTCCTTCGACCCCATCCCCATCCACTACTGCGCCCCCGCCGGCTACGCCATCCTGAAGTGCAACAACAAGACCTTCAACGGCACC
GGCCCGTGCAACAACGTGTCCACCGTGCAGTGCACGCACGGGATCAAGCCCGTGGTGTCCACGCAGCTGCTCCTGAACGGGTCGCTGG
CCGAGGGCGAGATCATCATCCGGTCGAAGAACATCACGGACAACGGGAAGACCATCATCGTGCACCTGAACGAGTCCGTGAAGATCGA
GTGCACCCGCCCGAGCAACAACACGCGCACCTCCATCCGGATCGGCCCTGGCCAGGCCTTCTACGCCACCGGCCAGGTGATCGGCGAC
ATCCGCGAGGCGCACTGCAACATCTCCGAGTCCAAGTGGAACGAGACCCTGCAGCGCGTGTCCGAGAAGCTGAAGGAGTACTTCCCCA
ACAAGAACATCACCTTCCAGCCGTCGTCCGGCGGCGACCTCGAGATCACCACGCACTCCTTCAACTGCGGTGGCGAGTTCTTCTACTG
CAACACGTCGTCGCTGTTCAACCGCACCTACATGGCCAACTCCACCGACATGGCCAACTCCACCGAGACCAACTCCACGCGCATCATC
ACGATCCGCTGCCGCATCAAGCAGATCATCAACATGTGGCAGGAGGTGGGCCGCGCCATGTACGCACCGCCCATCGCCGGCAACATCA
CCTGCATCTCCAACATCACCGGCCTCCTGCTGACCCGCGACGGCGGCAAGAACAACACCGAGACGTTCGAGACCTTCAGGCCAGGGGG
AGGCAACATGAAGGACAACTGGCGCTCCGAGCTGTACAAGTACAAGGTGGTGGAGGTGAAGCCCCTGGGCGTGGCACCCACCAACGCC
CGCGAGCGCGTCGTGGAGCGCGAGAAGGAGTAGTAAGaattcggtaaccaggacccggatcc
>HV1300595
gtcgacaagaagccaccATGCGCGTGACGGGCATCCAGCGCAACTACCCGCAGTGGTGGATCTGGTCGATGCTGGGCCTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGCGGACCAGATGCACGAGGACGTGATCTCCCTGTGGGACCAGTCCCTGAAGCCCTGCGTGAAGCTGACCCC
GCTGTGCGTGACCCTGAACTGCATCGACGCCAACGCGACCGCGTCCAACGCGACGGCATCCAACTCGTCCATCATCGAGGGGATGAAG
AACTGCTCCTTCAACATCACGACGGAGCTGCGCGACAAGATCGAGAAGAAGAACGCCCTGTTCTACAAGCTGGACATCGTGCAGCTGG
ACGGCAACTCCTCGCAGTACAGGCTGATCAACTGCAACACCTCCGTCATCACGCAGGCGTGCCCCAAGGTGTCCTTCGACCCCATCCC
CATCCACTACTGCGCCCCCGCCGGCTACGCCATCCTGAAGTGCAACAACAAGACCTTCAACGGCACCGGCCCGTGCAACAACGTGTCC
ACCGTGCAGTGCACGCACGGGATCAAGCCCGTGGTGTCCACGCAGCTGCTCCTGAACGGGTCGCTGGCCGAGGGCGAGATCATCATCC
GGTCGGAGAACATCACGAACAGCGCGAAGACCATCATCGTGCACCTGAACGAGTCCGTGAAGATCGAGTGCACCCGCCCGAGCAACAA
CACGCGCACCTCCATCCGGATCGGCCCTGGCCAGGCCTTCTACGCCACCGGCCAGGTGATCGGCGACATCCGCAAGGCGCACTGCAAC
ATCTCCGAGTCCAAGTGGAACGAGACCCTGCAGCGCGTGTCCAAGAAGCTGAAGGAGTACTTCCCCCACAAGAACATCACCTTCCAGC
CGTCGTCCGGCGGCGACCTCGAGATCACCACGCACTCCTTCAACTGCGGTGGCGAGTTCTTCTACTGCAACACGTCGTCGCTGTTCAA
CCGCACCTACATGGCCAACTCCACCGAGACCAACTCCACGCGCACGATCACGCTCCACTGCCGCATCAAGCAGATCATCAACATGTGG
CAGGAGGTGGGCCGCGCCATGTACGCACCGCCCATCGCCGGCAACATCACCTGCATCTCCAACATCACCGGCCTCCTGCTGACCCGCG
ACGGCGGCAACAACAACACCACGGAGACCTTCAGGCCAGGGGGAGGCAACATGAAGGACAACTGGCGCTCCGAGCTGTACAAGTACAA
GGTGGTGGAGATCAAGCCCCTGGGCGTGGCACCCACCAACGCCCGCGAGCGCGTCGTGGAGCGCGAGAAGGAGTAGTAAGaattcggt
aaccaggtcccggatcc
>HV1300596
gtcgacaagaagccaccATGCGCGTGATGGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCATCGACGCCACCGCGTCCAACGCGACGGCGATCAACATCTCCATCATCGAGGAGATGAAGAACTGC
TCCTTCAACATCACGACGGAGCTGCGCGACAAGCGCGAGAAGAAGAACGCCCTGTTCTACAAGCTGGACATCGTGCAGCTGGACGGCA
ACTCCTCGCAGCACAGGCTGATCAACTGCAACACCTCCGTCATCACGCAGGCGTGCCCCAAGGTGTCCTTCGACCCCATCCCCATCCA
CTACTGCGCCCCCGCCGGCTACGCCATCCTGAAGTGCAACAACAAGACCTTCAACGGCACCGGCCCGTGCAACAACGTGTCCACCGTG
CAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACGGGAAGACCATCATCGTGCACCTGAACGAGTCCGTGAAGATCGAGTGCACCCGCCCGAGCAACAACACGCG
CACCTCCATCCGGATCGGCCCTGGCCAGGCCTTCTACGCCACCGGCCAGGTGATCGGCAACATCCGCGAGGCGCACTGCAACATCTCC
AAGTCCAAGTGGAACGAGACCCTGCAGCGCGTGTCCGAGAAGCTGAAGGAGTACTTCCCCCACAAGAACATCACCTTCCAGCCGTCGT
CCGGCGGCGACCTCGAGATCACCACGCACTCCTTCAACTGCGGTGGCGAGTTCTTCTACTGCAACACGTCGTCGCTGTTCAACCGCAC
CTACATGGCCACCTCCACCGACATGGCCAACTCCACCGAGACCAACTCCACGCGCATCATCACGATCCGCTGCCGCATCAAGCAGATC
ATCAACATGTGGCAGGAGGTGGGCCGCGCCATGTACGCACCGCCCATCGCCGGCAACATCACCTGCATCTCCAACATCACCGGCCTCC
TGCTGACCCGCGACGGCGGCAAGAACGACACCGACACGGAGACCTTCAGGCCAGAGGGAGGCAACATGAAGGACAACTGGCGCTCCGA Fig. 16 (cont.)
GCTGTACAAGTACAAGGTGGTGGAGGTGAAGCCCCTGGGCGTGGCACCCACCAACGCCCGCGAGCGCGTCGTGGAGCGCGAGAAGGAG
TAGTAAGaattcggtaaccgggacctggatcc
>HV1300597
gtcgacaagaagccaccATGCGCGTGATGGGCATCCAGAAGAACTGCCCGCAGTGGTGGATCTGGTCGATGCTGGGCCTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACGGACGCCAACGCAACCGCGTCCAACTCGTCCATCATCAAGGGGATGAACTCGTCCATGATCGAG
GAGATGAAGAACTGCTCCTTCAACATCACGACGGAGCTGCGCGACAAGCGCGAGAAGAAGAACGCCCTGTTCTACAAGCTGGACATCG
TGCAGCTGGACGGCAACTCCTCGCAGTACAGGCTGATCAACTGCAACACCTCCGTCATCACGCAGGCGTGCCCCAAGGTGTCCTTCGA
CCCCATCCCCATCCACTACTGCGCCCCCGCCGGCTACGCCATCCTGAAGTGCAACAACAAGACCTTCAACGGCACCGGCCCGTGCAAC
AACGTGTCCACCGTGCAGTGCACGCACGGGATCAAGCCCGTGGTGTCCACGCAGCTGCTCCTGAACGGGTCGCTGGCCGAGGGCGAGA
TCATCATCCGGTCGAAGAACATCACGGACAACGGGAAGACCATCATCGTGCACCTGAACGAGTCCGTGAAGATCGAGTGCACCCGCCC
GAGCAACAACACGCGCACCTCCATCCGGATCGGCCCTGGCCAGGCCTTCTACGCCACCGGCCAGGTGATCGGCGACATCCGCGAGGCG
CACTGCAACATCTCCGAGTCCAAGTGGAACGAGACCCTGCAGCGCGTGTCCAAGAAGCTGAAGGAGTACTTCCCCCAGAAGGACATCA
CCTTCCAGCCGTCGTCCGGCGGCGACCTCGAGATCACCACGCACTCCTTCAACTGCGGTGGCGAGTTCTTCTACTGCAACACGTCGTC
GCTGTTCAACCGCACCTACATGGCCACCTCCACCGACATGGCCAACTCCACCGAGACCAACTCCACGCGCATCATCACGATCCGCTGC
CGCATCAAGCAGATCATCAACATGTGGCAGGAGGTGGGCCGCGCCATGTACGCACCGCCCATCGCCGGCAACATCACCTGCATCTCCA
ACATCACCGGCCTCCTGCTGACCCGCGACGGCGGCGAGAACGACACCGACACGGAGACCTTCAGGCCAGAGGGAGGCAACATGAAGGA
CAACTGGCGCTCCGAGCTGTACAAGTACAAGGTGGTGGAGGTGAAGCCCCTGGGCGTGGCACCCACCAACGCCCGCGAGCGCGTCGTG
GAGCGCGAGAAGGAGTAGTAAGaattcggtaaccgggtcctggatcc
>HV1300598
gtcgacaagaagccaccATGCGCGTGATGGGCATCCAGCGCTCGTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGCGCCTGACCCC
GCTGTGCGTGACCCTGAACTGCATCAACGCCACCAACGCGACGGCGTCGAACTCCTCCATCCTCGAGGGGATGAAGAACTGCTCCTTC
AACATCACGACGGAGCTGCGCGACAAGCGCGAGAAGAAGAACGCCCTGTTCTACAAGCTGGACATCGTGCAGCTGGACGGCAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACGGGAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCGACATCCGCGAGGCGCACTGCAACATCTCCGAGTCC
AAGTGGAACGAGACCCTGCAGCGCGTGTCCGAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGAACCTGTTCAACCGCACCTACAT
GGTGAACTCCACCGACATGGCCAACTCCACCGAGACCAACTCCACGCGCACCATCACGATCAGCTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCGAAGAACGACACCGACACGGAGACCTTCAGGCCAGAGGGAGGCAACATGAAGGACAACTGGCGCTCCGAGCTGTA
CAAGTACAAGGTGGTGGAGGTGAAGCCCCTGGGCGTGGCACCCACCAACGCCCGCGAGCGCGTCGTGGAGCGCGAGAAGGAGTAGTAA
Gaattcggttaccgggtcccggatcc
>HV1300599
gtcgacaagaagccaccATGCGCGTGATGGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCATCAACGCCACCAACGCGACGGCGTCGAACTCCTCCATCCTCGAGGGGATGAAGAACTGCTCCTTC
AACATCACGACGGAGCTGCGCGACAAGCGCGAGAAGAAGAACGCCCTGTTCTACAAGCTGGACATCGTGCAGCTGGACGGCAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCCAAGAACA
TCACGGACAACGGGAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCGACATCCGCGAGGCGCACTGCAACATCTCCGAGTCC
AAGTGGAACGAGACCCTGCAGCGCGTGTCCGAGAAGCTGAAGGAGTACTTCCCCCAGAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGCGACCTCCACCGACATGGCCAACTCCACCGAGACCAACTCCACGCGCATCATCACGATCCGCTGCCGCATCAAGCAGATCATCAAC

Fig. 16 (cont.)

ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAACGACACCGACACGGAGACCTTCAGGCCAGAGGGAGGCAACATGAAGGACAACTGGCGCTCCGAGCTGTACAA
GTACAAGGTGGTGGAGGTGAAGCCCCTGGGCGTGGCACCCACCAACGCCCGCGAGCGCGTCGTGGAGCGCGAGAAGGAGTAGTAAGaa
ttcggttaccaggacccggatcc
>HV1300600
gtcgacaagaagccaccATGCGCGTGATGGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACGGACGCCACCAACGCGACGGCGTCGAACTCCTCCATCCTCGGCGGGATGAAGAACTGCTCCTTC
AACATCACGACGGAGCTGCGCGACAAGCGCGAGAAGAAGAACGCCCTGTTCTACAAGCTGGACATCGTGCAGCTGGACGGCAACTCCT
CGCAGTACAGGCTGATCAACTGCAACACCTCCGCGATCACGCAGGCGTGCCCCAAGGTGTCCTTCGACCCCATCCCCATCCACTACTG
CGCCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACGGGAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCGACATCCGCGAGGCGCACTGCAACATCTCCGAGTCC
AAGTGGAACGAGACCCTGCAGCGCGTGTCCGAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGCGAACTCCACCGACATGGCCAACTCCACCGAGACCAACTCCACGCGCATCATCACGATCCGCTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAAGAACGACACCGACACGGAGACCTTCAGGCCAGAGGGAGGCAACATGAAGGACAACTGGCGCTCCGAGCTGTA
CAAGTACAAGGTGGTGGAGGTGAAGCCCCTGGGCGTGGCACCCACCAACGCCCGCGAGCGCGTCGTGGAGCGCGAGAAGGAGTAGTAA
Gaattcggttaccaggtcccggatcc
>HV1300601
gtcgacaagaagccaccATGCGCGTGCGCGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGCGCCTGACCCC
GCTGTGCGTGACCCTGAACTGCATCAACGCCACCAACGCGACGGCGTCGAACTCCTCCATCCTCGAGGGGATGAAGAACTGCTCCTTC
AACATCACGACGGAGCTGCGCGACAAGCGCGAGAAGAAGAACGCCCTGTTCTACAAGCTGGACATCGTGCAGCTGGACGGCAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACGGGAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCGACATCCGCGAGGCGCACTGCAACATCTCCGAGTCC
AAGTGGAACGAGACCCTGCAGCGCGTGTCCGAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGCGAACTCCACCGACATGGCCAACTCCACCGAGACCAACTCCACGCGCATCATCACGCTGCACTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAACGACACCGACACGGAGACCTTCAGGCCAGAGGGAGGCAACATGAAGGACAACTGGCGCTCCGAGCTGTACAA
GTACAAGGTGGTGGAGGTGAAGCCCCTGGGCGTGGCACCCACCAACGCCCGCGAGCGCGTCGTGGAGCGCGAGAAGGAGTAGTAAGaa
ttcggttaccgggacctggatcc
>HV1300602
gtcgacaagaagccaccATGCGCGTGATGGGCATCCAGCGCAACTACCCGCAGTGGTGGATCTGGTCGATGCTGGGCCTCTGGATGCT
CATGATCTGCAACGGCGTGCCGGTGTGGAAGGAGGCCAAGACGACCCTGTTCTGCGCGTCGGACGCCAAGGCCTACGAGAAGGAGGCG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGCGGACCAGATGCACGAGGACGTGATCTCCCTGTGGGACCAGTCCCTGAAGCCCTGCGTGAAGCTGACCCC
GCTGTGCGTGACCCTGAACTGCACGGACGCCAACGCCACCGCGTCGAACGCCAACGCGACCGCAAGCAACACCAACGCGACGGTGTCG
AACTCCTCCATCATCGAGGAGATGAAGAACTGCTCCTTCAACATCACGACGGAGCTGCGCGACAAGCGCGAGAAGAAGTACGCCCTGT
TCTACAAGCTGGACATCGTGCAGCTGGACGGCAACTCCTCGCAGTACAGGCTGATCAACTGCAACACCTCCGTCATCACGCAGGCGTG
CCCCAAGGTGTCCTTCGACCCCATCCCCATCCACTACTGCGCCCCCGCCGGCTACGCCATCCTGAAGTGCAACAACAAGACCTTCAAC
GGCACCGGCCCGTGCAACAACGTGTCCACCGTGCAGTGCACGCACGGGATCAAGCCCGTGGTGTCCACGCAGCTGCTCCTGAACGGGT
CGCTGGCCGAGGGCGAGATCATCATCCGGTCGGAGAACATCACGAACAGCGCGAAGACCATCATCGTGCACCTGAACGAGTCCGTGAA
GATCGAGTGCACCCGCCCGAGCAACAACACGCGCACCTCCATCCGGATCGGCCCTGGCCAGGCCTTCTACGCCACCGGCCAAGTGATC
GGCGACATCCGCAAGGCGCACTGCAACATCTCCGAGTCCAAGTGGAACGAGACCCTGCAGCGCGTGTCCAAGAAGCTGAAGGAGTACT

Fig. 16 (cont.)

```
TCCCCCACAAGAACATCACCTTCCAGCCGTCGTCCGGCGGCGACCCCGAGATCACCACGCACTCCTTCAACTGCGGTGGCGAGTTCTT
CTACTGCAACACGTCGTCCCTGTTCAACCGCACCTACATGGCGAACTCCACCGAGACCAACTCCACGCGCACCATCACGCTGCACTGC
CGCATCAAGCAGATCATCAACATGTGGCAGGAGGTGGGCCGCGCCATGTACGCACCGCCCATCGCCGGCAACATCACCTGCATCTCCA
ACATCACCGGCCTCCTGCTGACCCGCGACGGCGGCGAGAACACCCGGGACGGAGGCAACAACAACACGGAGACCTTCAGGCCAGGGGG
AGGCAACATGAAGGACAACTGGCGCTCCGAGCTGTACAAGTACAAGGTGGTGGAGGTGAAGCCCCTGGGCGTGGCACCCACCAACGCC
CGCGAGCGCGTCGTGGAGCGCGAGAAGGAGTAGTAAGaattcggttaccgggtcctggatcc
>HV1300603
gtcgacaagaagccaccATGCGCGTGATGGGCATCCAGCGCAACTACCCGCAGTGGTGGATCTGGTCGATGCTGGGCCTCTGGATGCT
CATGATCTGCAACGGCGTGCCGGTGTGGAAGAAGGCCAAGACGACCCTGTTCTGCGCGTCGGACGCCAAGGCCTACGAGAAGGAGGTG
CACAGCGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACGGACGCCAACGCCACCGCGTCGAACAGCTCCATCATCAAGGGGATGAACTCGTCCATGATCGAG
GAGATGAAGAACTGCTCCTTCAACATCACGACGGAGCTGCGCGACAAGCGCGAGAAGAAGAACGCCCTGTTCTACAAGCTGGACATCG
TGCAGCTGGACGGCAACTCCTCGCAGTACAGGCTGATCAACTGCAACACCTCCGTCATCACGCAGGCGTGCCCCAAGGTGTCCTTCGA
CCCCATCCCCATCCACTACTGCGCCCCCGCCGGCTACGCCATCCTGAAGTGCAACAACAAGACCTTCAACGGCACCGGCCCGTGCAAC
AACGTGTCCACCGTGCAGTGCACGCACGGGATCAAGCCCGTGGTGTCCACGCAGCTGCTCCTGAACGGGTCGCTGGCCGAGGGCGAGA
TCATCATCCGGTCGGAGAACATCACGAACAGCGCGAAGACCATCATCGTGCACCTGAACGAGTCCGTGAAGATCGAGTGCACCCGCCC
GAGCAACAACACGCGCACCTCCATCCGGATCGGCCCTGGCCAGGCCTTCTACGCCACCGGCCAGGTGATCGGCGACATCCGCAAGGCG
CACTGCAACATCTCCGAGTCCAAGTGGAACGAGACCCTGCAGCGCGTGTCCAAGAAGCTGAAGGAGTACTTCCCCGACCGGAACATCA
CCTTCCAGCCGTCGTCCGGCGGCGACCCCGAGATCACCACGCACTCCTTCAACTGCGGTGGCAAGTTCTTCTACTGCAACACGTCGTC
CCTGTTCAACCGCACCTACATGGCCAACTCGACGGACATGGCGAACTCCACCGAGACCAACTCCACGCGCATCATCACGATCCGGTGC
CGCATCAAGCAGATCATCAACATGTGGCAGGAGGTGGGCCGCGCCATGTACGCACCGCCCATCGCCGGCAACATCACCTGCATCTCCA
ACATCACCGGCCTCCTGCTGACCCGCGACGGAGGCAACAACAACACGGAGACCTTCAGGCCAGGTGGGAGGCAACATGAAGGACAACTG
GCGCTCCAAGCTGTACAAGTACAAGGTGGTGGAGGTGAAGCCCCTGGGCGTGGCACCCACCAAGGCCcgcGAGcgcatggtggagcgc
gagaagGAGTAGTAAGgtgaccgggacccgaattcggatcc
>HV1300604
gtcgacaagaagccaccATGCGCGTGATGGGCCGCCAGCGCAACTACCCGCAGTGGTGGATCTGGTCGATGCTGGGCCTGTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACGGACGCCAACGCCACCGCGTCCAACACGAACGCGACAGCGTCCAACATCAACGCGACAGCATCG
AAGAACTCCATCATCGAGGAGATGAAGAACTGCTCCTTCAACATCACGACGGAGCTGCGCGACAAGCGCGAGAAGAAGTACGCCCTGT
TCTACAAGCTGGACATCGTGCAGCTGGACGGCAACTCCTCGCAGTACAGGCTGATCAACTGCAACACCTCCGTCATCACGCAGGCGTG
CCCCAAGGTGTCCTTCGACCCCATCCCCATCCACTACTGCGCCCCCGCCGGCTACGCCATCCTGAAGTGCAACAACAAGACCTTCAAC
GGCACCGGCCCGTGCAACAACGTGTCCACCGTGCAGTGCACGCACGGGATCAAGCCCGTGGTGTCCACGCAGCTGCTCCTGAACGGGT
CGCTGGCCGAGGGCGAGATCATCATCCGGTCGAAGAACATCACGGACAACGGGAAGACCATCATCGTGCACCTGAACGAGTCCGTGAA
GATCGAGTGCACCCGCCCGAGCAACAACACGCGCACCTCCATCCGGATCGGCCCTGGCCAGGCCTTCTACGCCACCGGCCAAGTGATC
GGCGACATCCGCGAGGCGCACTGCAACATCTCCGAGTCCAAGTGGAACGAGACCCTGCAGCGCGTGTCCAAGAAGCTGAAGGAGTACT
TCCCCGACAAGAACATCACCTTCCAGTCGTCGTCCGGCGGCGACCCGGAGATCACCACGCACTCCTTCAACTGCGGTGGCGAGTTCTT
CTACTGCAACACGTCGTCCCTGTTCAACCGCACCTACATGGCGAACTCCACCGACATGGCCAACTCCACCGAGACCAACTCCACGCGC
ATCATCACGATCCGCTGCCGCATCAAGCAGATCATCAACATGTGGCAGGAGGTGGGCCGCGCCATGTACGCACCGCCCATCGCCGGCA
ACATCACCTGCATCTCCAACATCACCGGCCTCCTGCTGACCCGCGACGGCGGCAACTCTTCCACGGAGACCTTCAGGCCAGAGGGAGG
CAACATGAAGGACAACTGGCGCTCCGAGCTGTACAAGTACAAGGTGGTGGAGGTGAAGCCCCTGGGCGTGGCACCCACCAACGCCCGC
GAGCGCGTCGTGGAGCGCGAGAAGGAGTAGTAAGgtcaccgggacccgaattcggatcc
>HV1300605
gtcgacaagaagccaccATGAAGGTGCGGGGCATCCAGCGCAACTACCCGCAGTGGTGGATCTGGTCGATGCTGGGCCTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGGAGAACGTGACCGAGAACTTCAACA
TGTGGAAGAACGACATGGCGGACCAGATGCACGAGGACGTGATCTCCCTGTGGGACCAGTCCCTGAAGCCCTGCGTGAAGCTGACCCC
GCTGTGCGTGACCCTGAACTGCACGGACGCCAACGCCACCGCGTCGAACACCAACGCGACCGCAAGCAACATCAACGCGACGGCGTCG
AAGTCCTCCATCATCGAGGAGATGAAGAACTGCTCCTTCAACATCACGACGGAGCTGCGCGACAAGCGCGAGAAGAAGTACGCCCTGT
TCTACAAGCTGGACATCGTGCAGCTGGACGGCAACTCCTCGCAGTACAGGCTGATCAACTGCAACACCTCCGTCATCACGCAGGCGTG
CCCCAAGGTGTCCTTCGACCCCATCCCCATCCACTACTGCGCCCCCGCCGGCTACGCCATCCTGAAGTGCAACAACAAGACCTTCAAC
GGCACCGGCCCGTGCAACAACGTGTCCACCGTGCAGTGCACGCACGGGATCAAGCCCGTGGTGTCCACGCAGCTGCTCCTGAACGGGT
CGCTGGCCGAGGGCGAGATCATCATCCGGTCGGAGAACATCACGGACAACAGCAAGACCATCATCGTGCACCTGAACGAGTCCGTGAA
```

Fig. 16 (cont.)
GATCGAGTGCACCCGCCCGAGCAACAACACGCGCACCTCCATCCGGATCGGCCCTGGCCAGGCCTTCTACGCCACCGGCCAAGTGATC
GGCGACATCCGCGAGGCGCACTGCAACATCTCCGAGTCCAAGTGGAACGAGACCCTGCAGCGCGTGTCCAAGAAGCTGAAGGAGTACT
TCCCCGACAAGAACATCACCTTCCAGCCGTCGTCCGGCGGCGACCCCGAGATCACCACGCACTCCTTCAACTGCGGTGGCGAGTTCTT
CTACTGCAACACGTCGTCCCTGTTCAACCGCACCTACATGGCGAACTCCACCGAGACCAACTCCACGCGCACCATCACGCTGCACTGC
CGCATCAAGCAGATCATCAACATGTGGCAGGAGGTGGGCCGCGCCATGTACGCACCGCCCATCGCCGGCAACATCACCTGCATCTCCA
ACATCACCGGCCTCCTGCTGACCCGCGACGGCGGCGAGAACACCCGGGACGGAGGCAACAACAACACGGAGACCTTCAGGCCAGAGGG
AGGCAACATGAAGGACAACTGGCGCTCCGAGCTGTACAAGTACAAGGTGGTGGAGGTGAAGCCCCTGGGCGTGGCACCCACCAAGGCC
CGCGAGCGCGTCGTGGAGCGCGAGAAGGAGTAGTAAGgtaaccgggacccgaattcggatcc
>HV1300606
gtcgacaagaagccaccATGCGCGTGATGGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGCGGACCAGATGCACGAGGACGTGATCTCCCTGTGGGACCAGTCCCTGAAGCCCTGCGTGAAGCTGACCCC
GCTGTGCGTGACCCTGAACTGCACGGACGCCAACGCCACCGCTTCGAACATCAACGCGACGGCGTCGAAGTCCTCCATCATCGAGGAG
ATGAAGAACTGCTCCTTCAACATCACGACGGAGCTGCGCGACAAGCGCGAGAAGAAGTACGCCCTGTTCTACAAGCTGGACATCGTGC
AGCTGGACGGCAACTCCTCGCAGTACAGGCTGATCAACTGCAACACCTCCGTCATCACGCAGGCGTGCCCCAAGGTGTCCTTCGACCC
CATCCCCATCCACTACTGCGCCCCCGCCGGCTACGCCATCCTGAAGTGCAACAACAAGACCTTCAACGGCACCGGCCCGTGCAACAAC
GTGTCCACCGTGCAGTGCACGCACGGGATCAAGCCCGTGGTGTCCACGCAGCTGCTCCTGAACGGGTCGCTGGCCGAGGGCGAGATCA
TCATCCGGTCGGAGAACATCACGGACAACAGCAAGACCATCATCGTGCACCTGAACGAGTCCGTGAAGATCGAGTGCACCCGCCCGAG
CAACAACACGCGCACCTCCATCCGGATCGGCCCTGGCCAGGCCTTCTACGCCACCGGCCAAGTGATCGGCGACATCCGCGAGGCGCAC
TGCAACATCTCCGAGTCCAAGTGGAACGAGACCCTGCAGCGCGTCCAAGAAGCTGAAGGAGTACTTCCCCGACAAGAACATCACCT
TCCAGCCGTCGTCCGGCGGCGACCCCGAGATCACCACGCACTCCTTCAACTGCGGTGGCGAGTTCTTCTACTGCAACACGTCGTCCCT
GTTCAACCGCACCTACATGGCGAACTCCACCGAGACCAACTCCACGCGCACCATCACGCTGCACTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCGAGAACACCCGGGACGGAGGCAACAACAACACGGAGACCTTCAGGCCAGAGGGAGGCAACATGAAGGACAACTG
GCGCTCCGAGCTGTACAAGTACAAGGTGGTGGAGGTGAAGCCCCTGGGCGTGGCACCCACCAAGGCCCGCGAGCGCGTCGTGGAGCGC
GAGAAGGAGTAGTAAGgttaccgggacccgaattcggatcc
>HV1300607
gtcgacaagaagccaccATGCGCGTGATGGGCATCCAGCGCAACTACCCGCAGTGGTGGATCTGGTCGATGCTGGGCCTCTGGATGCT
CATGACCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGGAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACGGACGCCAACGCCACCGCGTCGAACACGAACGCGACCGCAAGCAACATCAACGCGACGGCGTCG
AAGTCCTCCATCATCGAGGAGATGAAGAACTGCTCCTTCAACATCACGACGGAGCTGCGCGACAAGCGCGAGAAGAAGTACGCCCTGT
TCTACAAGCTGGACATCGTGCAGCTGGACGGCAACTCCTCGCAGTACAGGCTGATCAACTGCAACACCTCCGTCATCACGCAGGCGTG
CCCCAAGGTGTCCTTCGACCCCATCCCCATCCACTACTGCGCCCCCGCCGGCTACGCCATCCTGAAGTGCAACAACAAGACCTTCAAC
GGCACCGGCCCGTGCAACAACGTGTCCACCGTGCAGTGCACGCACGGGATCAAGCCCGTGGTGTCCACGCAGCTGCTCCTGAACGGGT
CGCTGGCCGAGGGCGAGATCATCATCCGGTCGAAGAACATCACGGACAACGGGAAGACCATCATCGTGCACCTGAACGAGTCCGTGAA
GATCGAGTGCACCCGCCCGAGCAACAACACGCGCACCTCCATCCGGATCGGCCCTGGCCAGGCCTTCTACGCCACCGGCCAAGTGATC
GGCGACATCCGCGAGGCGCACTGCAACATCTCCGAGTCCAAGTGGAACGAGACCCTGCAGCGCGTGTCCAAGAAGCTGAAGGAGTACT
TCCCCGACAAGAACATCACCTTCCAGTCCTCGTCCGGCGGCGACCCCGAGATCACCACGCACTCCTTCAACTGCGGTGGCGAGTTCTT
CTACTGCAACACGTCGTCCCTGTTCAACCGCACCTACATGGCGAACTCGACGGACATGGCCAACTCCACCGAGACCAACTCCACGCGC
ATCATCACGATCCACTGCCGCATCAAGCAGATCATCAACATGTGGCAGGAGGTGGGCCGCGCCATGTACGCACCGCCCATCGCCGGCA
ACATCACCTGCATCTCCAACATCACCGGCCTCCTGCTGACCCGCGACGGCGGCGAGAACAACGGAGGCAAGAACAACACGGAGACCTT
CAGGCCAGGGGAGGCAACATGAAGGACAACTGGCGCTCCGAGCTGTACAAGTACAAGGTGGTGGAGGTGAAGCCCCTGGGCGTGGCA
CCCACCAAGGCCCGCGAGCGCGTCGTGGAGCGCGAGAAGGAGTAGTAAGgtgaccgggtcccgaattcggatcc
>HV1300608
gtcgacaagaagccaccATGCGCGTGTGCGCGGCATCCAGCGCAACTACCCGCAGTGGTGGATCTGGTCGATGCTGGGCCTCTGGATGCT
CATGATCTGCAACGGCGTGCCGGTGTGGAAGGAGGCCAAGACGACCCTGTTCTGCGCGTCGGACGCCAAGGCCTACGAGAAGGAGGCG
CACAACGTGTGGGCGACCCACGCCTGCGTGCCCACGGACCCCAACCCGCAGGAGATGGTGCTGAAGAACGTGACCGAGAACTTCAACA
TGTGGGAGAACGACATGGTGGACCAGATGCACGAGGACGTGATCTCCCTGTGGGACCAGTCCCTGAAGCCTGCGTGAAGCTGACCCC
GCTGTGCGTGACCCTGAACTGCACGGACGCCAACGCCACCGCGTCGAACACGAACGCGACCGCTCAGCAACATCAAGGCGACGGTGTCG
AACTCCTCCATCATCGAGGAGATGAAGAACTGCTCCTTCAACATCACGACGGAGCTGCGCGACAAGATCGAGAAGAAGTACGCCCTGT
TCTACAAGCTGGACATCGTGCAGCTGGACGGCAACTCCACGCAGTACCGCTTCATCAACTGCAACACCTCCGCGATCACGCAGGCGTG
CCCCAAGGTGTCCTTCGACCCCATCCCCATCCACTACTGCGCCCCCGCCGGCTACGCCATCCTGAAGTGCAACAACAAGACCTTCAAC Fig. 16 (cont.)
GGCACCGGCCCGTGCAACAACGTGTCCACCGTGCAGTGCACGCACGGGATCAAGCCCGTGGTGTCCACGCAGCTGCTCCTGAACGGGT
CGCTGGCCGAGGGCGAGATCATCATCCGGTCGGAGAACATCACGGACAACGGGAAGACCATCATCGTGCACCTGAACGAGTCCGTGAA
GATCGAGTGCACCCGCCCGGGGAACAACACGCGCACCTCCATCCGGATCGGCCCTGGCCAGGCCTTCTACGCCACCGGCCAAGTGATC
GGCGACATCCGCCAGGCGCACTGCAACATCTCCGAGTCCAAGTGGAACGAGACCCTGCAGCGCGTGTCCGAGAAGCTGAAGGAGTACT
TCCCCAACAAGACGATCACCTTCCAGCCGTCGTCCGGCGGCGACCCCGAGATCACCACGCACTCCTTCAACTGCGGTGGCGAGTTCTT
CTACTGCAACACGTCGTCCCTGTTCAACCGCACCTACATGGCGAACTCCACCGAGACCAACTCCACGCGCACCATCACGCTCCACTGC
CGCATCAAGCAGATCATCAACATGTGGCAGGAGGTGGGCCGCGCCATGTACGCACCGCCCATCGCCGGCAACATCACCTGCATCTCCA
ACATCACCGGCCTCCTGCTGACCCGCGACGGCGGCAACACGACGACATCGAGACCTTCAGGCCAGGGGGAGGCAACATGAAGGACAA
CTGGCGCTCCGAGCTGTACAAGTACAAGGTGGTGGAGGTGAAGCCCCTGGGCGTGGCACCCACCAAGGCCCGCGAGCGCGTCGTGGAG
CGCGAGAAGGAGTAGTAAGgtgaccaggacccgaattcggatcc
>HV1300609
gtcgacaagaagccaccATGCGCGTGCGCGGCATCCAGCGCAACTACCCGCAGTGGTGGATCTGGTCGATGCTGGGCCTCTGGATGCT
CATGATCTGCAACGGCGTGCCGGTGTGGAAGGAGGCCAAGACGACCCTGTTCTGCGCGTCGGACGCCAAGGCCTACGAGAAGGAGGCG
CACAACGTGTGGGCGACCCACGCCTGCGTGCCCACGGACCCCAACCCGCAGGAGATGGTGCTGAAGAACGTGACCGAGAACTTCAACA
TGTGGGAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACGGACGCCAACGCCACCGCGTCGAACGCCAACGCGACCGCCAGCAACACGAACGCGACGGTGTCG
AACGACTCCTCCATCATCGAGGAGATGAAGAACTGCTCCTTCAACATCACGACGGAGCTGCGCGACAAGATCGAGAAGAAGTACGCCC
TGTTCTACAAGCTGGACATCGTGCAGCTGGACGGCAACTCCACGCAGTACCGCTTCATCAACTGCAACACCTCCGCGATCACGCAGGC
GTGCCCCAAGGTGTCCTTCGACCCCATCCCCATCCACTACTGCGCCCCCGCCGGCTACGCCATCCTGAAGTGCAACAACAAGACCTTC
AACGGCACCGGCCCGTGCAACAACGTGTCCACCGTGCAGTGCACGCACGGGATCAAGCCCGTGGTGTCCACGCAGCTGCTCCTGAACG
GGTCGCTGGCCGAGGGCGAGATCATCATCCGGTCGGAAGAACATCACGGGAACCACATCATCGTGCACCTGAACGAGTCCGT
GAAGATCGAGTGCACCCGCCCGTCCAACAACGCGCACCTCCATCCGGATCGGCCCTGGCCAGGCCTTCTACGCCACCGGCCAAGTG
ATCGGCGACATCCGCCAGGCGCACTGCAACATCTCCGAGTCCAAGTGGAACGAGACCCTGCAGCGCGTGTCCGAGAAGCTGAAGGAGT
ACTTCCCCGACAAGAACATCACCTTCCAGCCGTCGTCCGGCGGCGACCCCGAGATCACCACGCACTCCTTCAACTGCGGTGGCGAGTT
CTTCTACTGCAACACGTCGTCCCTGTTCAACCGCACCTACATGGCGAACTCCACCGAGACCAACTCCACGCGCACCATCACGCTCCAC
TGCCGCATCAAGCAGATCATCAACATGTGGCAGGAGGTGGGCCGCGCCATGTACGCACCGCCCATCGCCGGCAACATCACCTGCATCT
CCAACATCACCGGCCTCCTGCTGACCCGCGACGGCGGCAACTCGTCCAAGGAGACCGAGACCTTCAGGCCAGGGGGAGGCAACATGAA
GGACAACTGGCGCTCCGAGCTGTACAAGTACAAGGTGGTGGAGGTGAAGCCCCTGGGCGTGGCACCCACCAACGCCCGCGAGCGCGTC
GTGGAGCGCGAGAAGGAGTAGTAAGgtgaccaggtcccgaattcggatcc
>HV1300610
gtcgacaagaagccaccATGCGCGTGCGCGGCATCCAGCGCAGCTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCATCAACGCCACCAACGCCACCTCCAACATCCTCAAGGGGGATGAAGAACTGCTCCTTC
AACATCACGACGGAGCTGCGCGACAAGCGCGAGAAGAAGAACGCCCTGTTCTACAAGCTGGACATCGTGCAGCTGGGCGGCAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCCGCCGGCTACGCCATCCTGAAGTGCAACAACAAGACGTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACAGCAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCAACATCCGCGAGGCGCACTGCAACATCTCCGAGTCC
AAGTGGAACGAGACCCTGCAGCGCGTGTCCGAGAAGCTGAAGAAGTACTTCCCCGACAAGAACATCACCTTCCGGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGCGACCTCCACGGACATGGCCAACTCCACCGAGACGAACTCCACGCGCATCATCACGATCCACTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAACAACACGGAGGACACGGAGACCTTCAGGCCAGAGGGAGGCAACATGAAGGACAACTGGCGCTCCGAGCTGTA
CAAGTACAAGGTGGTGGAGGTGAAGCCCCTGGGCGTGGCACCCACCAACGCCCGCGAGCGCGTCGTGGAGCGCGAGAAGGAGTAGTAA
Ggtgaccgggacctgaattcggatcc
>HV1300611
gtcgacaagaagccaccATGCGCGTGATGGGCACCCAGCGCAACTACCCGCAGTGGTGGATCTGGTCGATGCTGGGCCTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGGAAGAACGACATGGCGGACCAGATGCACGAGGACGTGATCTCCCTGTGGGACCAGTCCCTGAAGCCCTGCGTGAAGCTGACCCC
GCTGTGCGTGACCCTGTACTGCATCAACGCCACCGCCAACGCGACGGTCTCGAACTCCTCGATCATCGAGGAGATGAAGAACTGCTCC
TTCAACATCACGACGGAGCTGCGCGACAAGCGCGAGAAGAAGAACGCCCTGTTCTACAAGCTGGACATCGTGCAGCTGGACGGCAACT

Fig. 16 (cont.)

```
CCTCGCAGTACAGGCTGATCAACTGCAACACCTCCGCGATCACGCAGGCGTGCCCCAAGGTGTCCTTCGACCCCATCCCCATCCACTA
CTGCGCCCCGCCGGCTACGCCATCCTGAAGTGCAACAACAAGACCTTCAACGGCACCGGCCCGTGCAACAACGTGTCCACCGTGCAG
TGCACGCACGGGATCAAGCCCGTGGTGTCCACGCAGCTGCTCCTGAACGGGTCGCTGGCCGAGGGCGAGATCATCATCCGGTCGGAGA
ACATCACGAACAGCGCGAAGACCATCATCGTGCACCTGAACGAGTCCGTGAAGATCGAGTGCACCCGCCCGAGCAACAACACGCGCAC
CTCCATCCGGATCGGCCCTGGCCAGGCCTTCTACGCCACCGGCCAGGTGATCGGCGACATCCGCCAGGCGCACTGCAACATCTCCGAG
TCCAAGTGGAACGAGACCCTGCAGCGCGTGTCCGAGAAGCTGAAGGAGTACTTCCCCAACAAGACGATCACCTTCCAGCCGTCGTCCG
GCGGCGACCCCGAGATCACCACGCACTCCTTCAACTGCGGTGGCGAGTTCTTCTACTGCAACACGTCGTCCCTGTTCAACCGCACCTA
CATGGCGAACTCCACCGACATGGCCAACTCCACCGAGACGAACTCCACGCGCACCATCACGCTCCACTGCCGCATCAAGCAGATCATC
AACATGTGGCAGGAGGTGGGCCGCGCCATGTACGCACCGCCCATCGCCGGCAACATCACCTGCATCTCCAACATCACCGGCCTCCTGC
TGACCCGCGACGGCGGCAACAGCTCCAAGGAGACGGAGACCTTCAGGCCAGGGGGAGGCAACATGAAGGACAACTGGCGCTCCGAGCT
GTACAAGTACAAGGTGGTGGAGGTGAAGCCCCTGGGCGTGGCACCCACCAACGCCCGCGAGCGCGTCGTGGAGCGCGAGAAGGAGTAG
TAAGgtgaccgggtcctgaattcggatcc
>HV1300612
gtcgacaagaagccaccATGCGCGTGCGCGGCATCCAGCGCAGCTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGGAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCATCAACGCCACCAACGCGACGGACTCGAACTCCAACATCCTCGAGGGGATGAAGAACTGCTCCTTC
AACATCACGACGGAGCTGCGCGACAAGCGCGAGAAGAAGAACGCCCTGTTCTACAAGCTGGACATCGTGCAGCTGGGCGGCAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCCGCCGGCTACGCCATCCTGAAGTGCAACAACAAGACCTTCAACGGCACCGGCCCGTGCAACAACGTGTCCACCGTCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACAGCAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCAACATCCGCGAGGCGCACTGCAACATCTCCGAGTCC
AAGTGGAACGAGACCCTGCAGCGCGTGTCCGAGAAGCTGAAGAAGTACTTCCCCGACAAGAACATCACCTTCCGGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGCGACGTCCACCGACATGGCCAACTCCACCGAGACGAACTCCACGCGCATCATCACGATCCACTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAACAACACGGAGGACACGGAGACCTTCAGGCCAGAGGGAGGCAACATGAAGGACAACTGGCGCTCCGAGCTGTA
CAAGTACAAGGTGGTGGAGGTGAAGCCCCTGGGCGTGGCACCCACCAACGCCCGCGAGCGCGTCGTGGAGCGCGAGAAGGAGTAGTAA
Ggtcaccgggtcccgaattcggatcc
>HV1300613
gtcgacaagaagccaccATGCGCGTGATGGGCATCCAGCGCAGCTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGGAGAACGACATGGTGGACCAGATGCACGAGGACGTGATCTCCCTGTGGGACCAGTCCCTGAAGCCCTGCGTGAAGCTGACCCC
GCTGTGCGTGACCCTGAGCTGCATCAACGCCACCAACGCGACGGACTCGAACAACTCCATCCTCGAGGGGATGAAGAACTGCTCCTTC
AACATCACGACGGAGCTGCGCGACAAGCGCGAGAAGAAGAACGCCCTGTTCTACAAGCTGGACATCGTGCAGCTGTACGGCAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACGGGAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCAACATCCGCGAGGCGCACTGCAACATCTCCGAGTCC
AAGTGGAACGAGACCCTGCAGCGCGTGTCCGAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGCGACGTCCACCGACATGGCCAACTCCACCGAGACCAACTCCACGCGCATCATCACGATCCACTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAACAACACGGAGGACACGGAGACCTTCAGGCCAGAGGGAGGCAACATGAAGGACAACTGGCGCTCCGAGCTGTA
CAAGTACAAGGTGGTGGAGGTGAAGCCCCTGGGCGTGGCACCCACCAACGCCCGCGAGCGCGTCGTGGAGCGCGAGAAGGAGTAGTAA
Ggtcaccaggacccgaattcggatcc
>HV1300614
gtcgacaagaagccaccATGCGCGTGATGGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGGAGAACGACATGGTGGACCAGATGCACGAGGACGTGATCTCCCTGTGGGACCAGTCCCTGAAGCCCTGCGTGAAGCTGACCCC
```

Fig. 16 (cont.)
GCTGTGCGTGACCCTGAACTGCATCAACGCCACCAACGCGACGGACTCGAACTCCAACATCCTCGAGGGGATGAAGAACTGCTCCTTC
AACATCACGACGGAGCTGCGCGACAAGCGCGAGAAGAAGAACGCCCTGTTCTACAAGCTGGACATCGTGCAGCTGGGCGGCAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACAGCAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCAACATCCGCGAGGCGCACTGCAACATCTCCGAGTCC
AAGTGGACGGAGACCCTGCAGCGCGTGTCCGAGAAGCTGAAGAAGTACTTCCCCGACAAGAACATCACCTTCCGGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGCGACGTCCACCGACATGGCCAACTCCACCGAGATCAACTCCACGCGCATCATCACGATCCACTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAACAACACGGAGGACACGGAGACCTTCAGGCCAGAGGGAGGCAACATGAAGGACAACTGGCGCTCCGAGCTGTA
CAAGTACAAGGTGGTGGAGGTGAAGCCCCTGGGCGTGGCACCCACCAACGCCCGCGAGCGCGTCGTGGAGCGCGAGAAGGAGTAGTAA
Ggtcaccaggtcccgaattcggatcc
>HV1300615
gtcgacaagaagccaccATGCGCGTGATGGGCCGGCAGCGCAACTACCCGCAGTGGTGGATCTGGTCGATGCTGGGCCTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGACGCCCTGCGTGAAGCTGACCCC
GCTGTGCGTGACCCTGAACTGCACGGACGCCAACGACACCGCGTCGAACAGCTCCATCATCAAGGGGATGAACAACTCCATCGTGGGG
GAGATGAAGAACTGCTCCTTCAACATCACGACGGAGCTGCGCGACAAGCGCGAGAAGAAGAACGCCCTGTTCTACAAGCTGGACATCG
TGCAGCTGGACGGCAACTCCTCGGAGTACAGGCTGATCAACTGCAACACCTCCGTCATCACGCAGGCGTGCCCCAAGGTGTCCTTCGA
CCCCATCCCCATCCACTACTGCGCCCCCGCCGGCTACGCCATCCTGAAGTGCAACAACAAGACCTTCAACGGCACCGGCCCGTGCAAC
AACGTGTCCACCGTGCAGTGCACGCACGGGATCAAGCCCGTGGTGTCCACGCAGCTGCTCCTGAACGGGTCGCTGGCCGAGGGCGAGA
TCATCATCCGGTCGGAGAACATCACGGACAACGCGAAGACCATCATCGTGCACCTGAACGAGTCCGTGAAGATCGAGTGCACCCGCCC
GAGCAACAACACGCGCACCTCCATCCGGATCGGCCCTGGCCAGGCCTTCTACGCCACCGGCCAGGTGATCGGCGACATCCGCAAGGCG
CACTGCAACATCTCCGAGTCCAAGTGGAACGAGACCCTGCAGCGCGTGTCCAAGAAGCTGAAGGAGTACTTCCCCGACAAGAACATCA
CCTTCCAGCCGTCGTCCGGCGGCGACCCCGAGATCACCACGCACTCCTTCAACTGCGGTGGCGAGTTCTTCTACTGCAACACGTCGTC
CCTGTTCAACCGCACCTACATGGCCAACTCGACGGACATGGCGAACTCCGCGGAGACCAACTCCACGCGCACCATCACGCTCCACTGC
CGCATCAAGCAGATCATCAACATGTGGCAGGAGGTGGGCCGCGCCATGTACGCACCGCCCATCGCCGGCAACATCACCTGCATCTCCA
ACATCACCGGCCTCCTGCTGACCCGCGACGGAGGCAACTCCAGCACGGAGACGGAGACCTTCAGGCCAGGGGGAGGCAACATGAAGGA
CAACTGGCGCTCCGAGCTGTACAAGTACAAGGTGGTGGAGGTGAAGCCCCTGGGCGTGGCACCCACCAACGCCcgcGAGcgcgtggtg
gagcgcgagaagGAGTAGTAAGgtcaccgggacctgaattcggatcc
>HV1300616
gtcgacaagaagccaccATGCGCGTGCGCGGCATCCAGCGCAGCTACCCGCAGTGGTGGATCTGGTCGATGCTGGGCTTCTGGATGCT
CATGATCTGCAACGGCGTGCCGGTGTGGCGGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGGAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCATCAACGCCACCAACGCGACGGACTCGAACTCCAACATCCTCGAGGGGATGAAGAACTGCTCCTTC
AACATCACGACGGAGCTGCGCGACAAGCGCGAGAAGAAGAACGCCCTGTTCTACAAGCTGGACATCGTGCAGCTGGGCGGCAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACAGCAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCAACATCCGCGAGGCGCACTGCAACATCTCCGAGTCC
AAGTGGAACGAGACCCTGCAGCGCGTGTCCAAGAAGCTGAAGAAGTACTTCCCCGACAAGAACATCACCTTCCGGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGCGACGTCCATCGACATGGCCAACTCCACCGAGACGAACTCCACGCGCATCATCACGATCCACTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAACAACACGGAGGACACGGAGACCTTCAGGCCAGAGGGAGGCAACATGAAGGACAACTGGCGCTCCGAGCTGTA
CAAGTACAAGGTGGTGGAGGTGAAGCCCCTGGGCGTGGCACCCACCAACGCCCGCGAGCGCGTCGTGGAGCGCGAGAAGGAGTAGTAA
Ggtcaccgggtcctgaattcggatcc
>HV1300617
gtcgacaagaagccaccATGCGCGTGCGCGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG Fig. 16 (cont.)
```
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCATCAACGCCACCAACGCGACGGCGTCGAACTCCAACATCCTCGAGGGGATGAAGAACTGCTCCTTC
AACATCACGACGGAGCTGCGCGACAAGCGCGAGAAGAAGAACGCCCTGTTCTACAAGCTGGACATCGTGCAGCTGGGCGGCAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACAGCAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCAACATCCGCGAGGCGCACTGCAACATCTCCGAGTCC
AAGTGGAACGAGACCCTGCAGCGCGTGTCCGAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGCGAACTCCACGGACATGGCCAACTCCACCGAGACGAACTCCACGCGCATCATCACGCTCCACTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAACAACACGGAGGACACGGAGACCTTCAGGCCAGAGGGAGGCAACATGAAGGACAACTGGCGCTCCGAGCTGTA
CAAGTACAAGGTGGTGGAGGTGAAGCCCCTGGGCGTGGCACCCACCAACGCCCGCGAGCGCGTCGTGGAGCGCGAGAAGGAGTAGTAA
Ggtaaccgggtcccgaattcggatcc
>HV1300618
gtcgacaagaagccaccATGGCGCGTGCGCGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCATCAACGCCACCAACGCGACGGACTCGAACTCCAACATCCTCGAGGGGATGAAGAACTGCTCCTTC
AACATCACGACGGAGCTGCGCGACAAGCGCGAGAAGAAGAACGCCCTGTTCTACAAGCTGGACATCGTGCAGCTGGGCGGCAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACAGCAAGACCATCATCGTGCACGAGTCCGTGAAGATCGAGTGCACCCGCCCGAGCAACAACACGCGCACCTC
CATCCGGATCGGCCCTGGCCAGGCCTTCTACGCCACCGGTGATCGGCAACATCCGCGAGGCGCACTGCAACATCTCCGAGTCC
AAGTGGAACGAGACCCTGCAGCGCGTGTCCGAGAAGCTGAAGAAGTACTTCCCCGACAAGAACATCACCTTCCGGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGCGACCTCCACGGACATGGCCAACTCCACCGAGACGAACTCCACGCGCATCATCACGATCCACTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAACAACACGGAGGACACGGAGACCTTCAGGCCAGAGGGAGGCAACATGAAGGACAACTGGCGCTCCGAGCTGTA
CAAGTACAAGGTGGTGGAGGTGAAGCCCCTGGGCGTGGCACCCACCAACGCCCGCGAGCGCGTCGTGGAGCGCGAGAAGGAGTAGTAA
Ggtaaccaggacccgaattcggatcc
>HV1300619
gtcgacaagaagccaccATGGCGCGTGCGCGGCATCCAGCGCAGCTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGGAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCATCAACGCCACCAACGCGACGGCGTCGAACTCCAACATCCTCGAGGGGATGAAGAACTGCTCCTTC
AACATCACGACGGAGCTGCGCGACAAGCGCGAGAAGAAGAACGCCCTGTTCTACAAGCTGGACATCGTGCAGCTGGGCGGCAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCCGCCGGCTACGCCATCCTGAAGTGCAACAACAAGGCGTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACAGCAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCAACATCCGCGAGGCGCACTGCAACATCTCCGAGTCC
AAGTGGAACGAGACCCTGCAGCGCGTGTCCGAGAAGCTGAAGAAGTACTTCCCCGACAAGAACATCACCTTCCGGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGCGACCTCCACGGACATGGCCAACTCCACCGAGACGAACTCCACGCGCATCATCACGATCCACTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAACAACACGGAGGACACGGAGACCTTCAGGCCAGAGGGAGGCAACATGAAGGACAACTGGCGCTCCGAGCTGTA
CAAGTACAAGGTGGTGGAGGTGAAGCCCCTGGGCGTGGCACCCACCAACGCCCGCGAGCGCGTCGTGGAGCGCGAGAAGGAGTAGTAA
Ggtaaccaggtcccgaattcggatcc
>HV1300620
```

Fig. 16 (cont.)

```
gtcgacaagaagccaccATGCGCGTGCGCGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGGAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCATCAACGCCACCAACGCGACGGACTCGAAGTCCAACATCCTCGAGGGGATGAAGAACTGCTCCTTC
AACATCACGACGGAGCTGCGCGACAAGCGCGAGAAGAAGAACGCCCTGTTCTACAAGCTGGACATCGTGCAGCTGGGCGGGAACTCCA
ACAGCTCGCAGTACAGGCTGATCAACTGCAACACCTCCGTCATCACGCAGGCGTGCCCCAAGGTGTCCTTCGACCCCATCCCCATCCA
CTACTGCGCCCCCGCCGGCTACGCCATCCTGAAGTGCAACAACAAGACCTTCAACGGCACCGGCCCGTGCAACAACGTGTCCACCGTG
CAGTGCACGCACGGGATCAAGCCCGTGGTGTCCACGCAGCTGCTCCTGAACGGGTCGCTGGCCGAGGGCGAGATCATCATCCGGTCCA
AGAACATCACGGACAACAGCAAGACCATCATCGTGCACCTGAACGAGTCCGTGAAGATCGAGTGCACCCGCCCGAGCAACAACACGCG
CACCTCCATCCGGATCGGCCCTGGCCAGGCCTTCTACGCCACCGGCCAGGTGATCGGCAACATCCGCGAGGCGCACTGCAACATCTCC
GAGTCCAAGTGGAACGAGACCCTGCAGCGCGTGTCCGAGAAGCTGAAGGAGTACTTCCCCCAGAAGAACATCACCTTCCAGCCGTCGT
CCGGCGGCGACCTCGAGATCACCACGCACTCCTTCAACTGCGGTGGCGAGTTCTTCTACTGCAACACGTCGTCCCTGTTCAACCGCAC
CTACATGGCGACGGGCACCGACATGGCCAACTCCACCGAGACGAACATCATCACGATCCACTGCCGCATCAAGCAGATCATCAACATG
TGGCAGGAGGTGGGCCGCGCCATGTACGCACCGCCCATCGCCGGCAACATCACCTGCATCTCCAACATCACCGGCCTCCTGCTGACCC
GCGACGGCGGCAACTCCACGGAGGACACGGAGACCTTCAGGCCAGTGGGAGGCAACATGAAGGACAACTGGTCGTCCGAGCTGTACAA
GTACAAGGTGGTGGAGGTGAAGCCCCTGGGCGTGGCACCCACCAACGCCCGCGAGCGCGTCGTGGAGCGCGAGAAGGAGTAGTAAGgt
aaccgggacctgaattcggatcc
>HV1300621
gtcgacaagaagccaccATGCGCGTGCGCGGCATCCAGCGCAGCTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGGAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCATCAACGCCACCAACGCGACGGCCTCGGACTCCGATCCTCGACGGGATGAAGAACTGCTCCTTC
AACATCACGACGGAGCTGCGCGACAAGCGCGAGAAGAAGAACGCCCTGTTCTACAAGCTGGACATCGTGCAGCTGGGCTCCAACAGCT
CGCAGTACAGGCTGATCAACTGCAACACCTCCGTCATCACGCAGGCGTGCCCCAAGGTGTCCTTCGACCCCATCCCCATCCACTACTG
CGCCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACAGCAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCAACATCCGCGAGGCGCACTGCAACATCTCCGAGTCC
AAGTGGAACGAGACCCTGCAGCGCGTGTCCGAGAAGCTGAAGGAGTACTTCCCCGACAAGAAGATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGCGAACAGCACCGACATGGCCAACTCCACCGAGACGAACTCGACGCAGATCATCACGATCCACTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAACAACACGGAGGACACGGAGACCTTCAGGCCAGTGGGAGGCAACATGAAGGACAACTGGTCGTCCGAGCTGTA
CAAGTACAAGGTGGTGGAGGTGAAGCCCCTGGGCGTGGCACCCACCAACGCCCGCGAGCGCGTCGTGGAGCGCGAGAAGGAGTAGTAA
Ggtaaccgggtcctgaattcggatcc
>HV1300622
gtcgacaagaagccaccATGCGCGTGCGCGGCATCCAGCGCAGCTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCATCAACGCCACCAACGCGACGGACTCGAAGTCCAACATCCTCGAGGGGATGAAGAACTGCTCCTTC
AACATCACGACGGAGCTGCGCGACAAGCGCGAGAAGAAGAACGCCCTGTTCTACAAGCTGGACATCGTGCAGCTGGGCGGGAACAGCT
CGCAGTACAGGCTGATCAACTGCAACACCTCCGTCATCACGCAGGCGTGCCCCAAGGTGTCCTTCGACCCCATCCCCATCCACTACTG
CGCCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACAGCAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCAACATCCGCGAGGCGCACTGCAACATCTCCGAGTCC
AAGTGGAACGAGACCCTGCAGCGCGTGTCCGAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGCGAACAGCACCGACATGGCCAACTCCACCGAGACGAACTCGACGCAGATCATCACGATCCACTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAACAACACGGAGGACACGGAGACCTTCAGGCCAGTGGGAGGCAACATGAAGGACAACTGGTCGTCCGAGCTGTA
```

Fig. 16 (cont.)
CAAGTACAAGGTGGTGGAGGTGAAGCCCCTGGGCGTGGCACCCACCAAGGCCCGCGAGCGCGTCGTGGAGCGCGAGAAGGAGTAGTAA
GgttaccgggtcccgaattcggatCC
>HV1300623
gtcgacaagaagccaccATGCGCGTGCGCGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGGAGAACGACATGGTGGACCAGATGCACGAGGACGTGATCTCCCTGTGGGACCAGTCCCTGAAGCCCTGCGTGCGGCTGACCCC
GCTGTGCGTGACCCTGAACTGCATCAACGCCACCAACGCGACGGCCTCGGACTCCAGCATCCTCGACGGGATGAAGAACTGCTCCTTC
AACATCACGACGGAGCTGCGCGACAAGCGCGAGAAGAAGAACGCCCTGTTCTACAAGCTGGACATCGTGCAGCTGGGCGGGAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACAGCAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCAACATCCGCGAGGCGCACTGCAACATCTCCGAGTCC
AAGTGGAACGAGACCCTGCAGCGCGTGTCCGAGAAGCTGAAGAAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGCGACGTCCACCGACCTCGCCAACTCCACCGAGACGAACATCATCACGATCCACTGCCGCATCAAGCAGATCATCAACATGTGGCAG
GAGGTGGGCCGCGCCATGTACGCACCGCCCATCGCCGGCAACATCACCTGCATCTCCAACATCACCGGCCTCCTGCTGACCCGCGACG
GCGGCAACAACACGGAGGACACGGAGACCTTCAGGCCAGTGGGAGGCAACATGAAGGACAACTGGTCGTCCGAGCTGTACAAGTACAA
GGTGGTGGAGGTGAAGCCCCTGGGCGTGGCACCCACCAACGCCcgcGAGcgcgtcgtgaagagggagaagGAGTAGTAAGgttaccag
gacccgaattcggatcc
>HV1300624
gtcgacaagaagccaccATGCGCGTGATGGGCAGGCAGCGCAACTACCCGCAGTGGTGGATCTGGTCGATGCTGGGCCTCTGGATGCT
CATGATCTGCAACGGCGTGCCGGTGTGGAAGGAGGCCAAGACGACCCTGTTCTGCGCGTCGGACGCCAAGGGCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGGAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACGGACGCCAACGCCACCGCGTCGAACGCCAACGCGACCGTGAGCAACACGAACGCGACGGTGTCG
AACGACTCCTCCATCATCGAGGAGATGAAGAACTGCTCCTTCAACATCACGACGGAGCTGCGCGACAAGATCGAGAAGAAGTACGCCC
TGTTCTACAAGCTGGACATCGTGCAGCTGGACGGCAACTCCACGCACTACCGCTTCATCAACTGCAACACCTCCGCGATCACGCAGGC
GTGCCCCAAGGTGTCCTTCGACCCCATCCCCATCCACTACTGCGCCCCCGCCGGCTACGCCATCCTGAAGTGCAACAACAAGACCTTC
AACGGCACCGGCCCGTGCAACAACGTGTCCACCGTGCAGTGCACGCACGGGATCAAGCCCGTGGTGTCCACGCAGCTGCTCCTGAACG
GGTCGCTGGCCGAGGGCGAGATCATCATCCGGTCGAAGAACATCACGGACAACAGCAAGGAAGACCATCATCGTGCACCTGAACGAGTCCGT
GAAGATCGAGTGCACCCGCCCGTCCAACAACACGCGCACCTCCATCGGGATCGGCCCTGGCCAGGCCTTCTACGCCACCGGCCAGGTC
ATCGGCGACATCCGCAAGGCGCACTGCAACATCTCCGAGTCCAAGTGGAACGAGACCCTGCAGCGCGTGTCCAAGAAGCTGAAGGAGT
ACTTCCCCGGCAAGAACATCACCTTCCAGCCGTCGTCCGGCGGCGACCCCGAAGTGACCACGCACTCCTTCAACTGCGGTGGCGAGTT
CTTCTACTGCAACACGTCGTCCCTGTTCAACCGCACCTACATGACGAACAGCACGGACATGGCGAACTCCACCGAGACCAACCGCACC
ATCACGATCCACTGCCGCATCAAGCAGATCATCAACATGTGGCAGGAGGTGGGCCGCGCCATGTACGCACCGCCCATCGCCGGCAACA
TCACCTGCATCTCCAACATCACCGGCCTCCTGCTGACCCGCGACGGCGGCAACTCGTCCACGGAGACCGAGACCTTCAGGCCAGAGGG
AGGCAACATGAAGGACAACTGGCGCTCCGAGCTGTACAAGTACAAGGTGGTGGAGGTGAAGCCCCTGGGCGTGGCACCCACCAACGCC
CGCGAGCGCGTCGTGGAGCGCGAGAAGGAGTAGTAAGgttaccaggtcccgaattcggatcc
>HV1300625
gtcgacaagaagccaccATGCGCGTGCGCGGCATCCAGCGCAGCTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCATCAACGCCACCAACGCGACGGACTCGAAGTCCAACATCCTCGAGGGGATGAAGAACTGCTCCTTC
AACATCACGACGGAGCTGCGCGACAAGCGCGAGAAGAAGAACGCCCTGTTCTACAAGCTGGACATCGTGCAGCTGGGCTCCAACAGCT
CGCAGTACAGGCTGATCAACTGCAACACCTCCGTCATCACGCAGGCGTGCCCCAAGGTGTCCTTCGACCCCATCCCCATCCACTACTG
CGCCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACAGCAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCAACATCCGCGAGGCGCACTGCAACATCTCCGAGTCC
AAGTGGAACGAGACCCTGCAGCGCGTGTCCGAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGCGAACAGCACCGACATGGCCAACTCCACCGAGACGAACTCGACGCAGATCATCACGATCCACTGCCGCATCAAGCAGATCATCAAC

Fig. 16 (cont.)
```
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAACAACACGGAGGACACGGAGACCTTCAGGCCAGTGGGAGGCAACATGAAGGACAACTGGTCGTCCGAGCTGTA
CAAGTACAAGGTGGTGGAGGTGAAGCCCCTGGGCGTGGCACCCACCAACGCCCGCGAGCGCGTCGTGGAGCGCGAGAAGGAGTAGTAA
Ggttaccgggacctgaattcggatcc
>HV1300626
gtcgacaagaagccaccATGCGCGTGCGCGGCATCCAGCGCAGCTACCCGCAGTGGTGGATCTGGTCGATGCTGGGCCTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGGAGAACGACATGGTGGACCAGATGCACGAGGACGTGATCTCCCTGTGGGACCAGTCCCTGAAGCCCTGCGTGCGGCTGACCCC
GCTGTGCGTGACCCTGAACTGCATCAACGCCACCAACGCGACGGCCTCGGACTCCAGCATCCTCGACGGGATGAAGAACTGCTCCTTC
AACATCACGACGGAGCTGCGCGACAAGCGCGAGAAGAAGAACGCCCTGTTCTACAAGCTGGACATCGTGCAGCTGGGCGGGAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACAGCAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCAACATCCGCGAGGCGCACTGCAACATCTCCGAGTCC
AAGTGGAACGAGACCCTGCAGCGCGTGTCCGAGAAGCTGAAGAAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACAT
GGCGACGTCCACCGACATGGCCAACTCCACCGAGACGAACATCATCACGATCCACTGCCGCATCAAGCAGATCATCAACATGTGGCAG
GAGGTGGGCCGCGCCATGTACGCACCGCCCATCGCCGGCAACATCACCTGCATCTCCAACATCACCGGCCTCCTGCTGACCCGCGACG
GCGGCAACAACACGGAGGACACGGAGACCTTCAGGCCAGTGGGAGGCAACATGAAGGACAACTGGTCGTCCGAGCTGTACAAGTACAA
GGTGGTGGAGGTGAAGCCCCTGGGCGTGGCACCCACCAACGCCcgcGAGcgcgtcgtggagagggagaagGAGTAGTAAGgttaccgg
gtcctgaattcggatcc
>HV1300627
gtcgacaagaagccaccATGCGCGTGCGCGGCATCCAGCGCAGCTACCCGCAGTGGTGGATCTGGTCGATGCTGGGCTTCTGGATGCT
CATGATCTGCAACGGCATGTGGGTGACGGTGTACTACGGCGTGCCGGTGtGGAAGGAGGCCAAGACGACCCTGTTCTGCGCGTCGGAC
GCCAAGGCCTACGAGAAGGAGGTGCACAACGTGTGGGCGACCCACGCCTGCGTGCCCACGGACCCCAACCCGCAGGAGATGGTGCTGA
AGAACGTGACCGAGAACTTCAACATGTGGGAGAACGACATGGTGGACCAGATGCACGAGGACGTGATCTCCCTGTGGGACCAGTCCCT
GAAGCCCTGCGTGAAGCTGACCCCGCTGTGCGTGACCCTGAACTGCATCAACGCCACCAACGCGACGGCCTCGGACTCCAGCATCCTC
GACGGGATGAAGAACTGCTCCTTCAACATCACGACGGAGCTGCGCGACAAGCGCGAGAAGAAGAACGCCCTGTTCTACAAGCTGGACA
TCGTGCAGCTGGGCAGCAACTCCTCGCAGTACAGGCTGATCAACTGCAACACCTCCGTCATCACGCAGGCGTGCCCCAAGGTGTCCTT
CGACCCCATCCCCATCCACTACTGCGCCCCCGCCGGCTACGCCATCCTGAAGTGCAACAACAAGACCTTCAACGGCACCGGCCCGTGC
AACAACGTGTCCACCGTGCAGTGCACGCACGGGATCAAGCCCGTGGTGTCCACGCAGCTGCTCCTGAACGGGTCGCTGGCCGAGGGCG
AGATCATCATCCGGTCGAAGAACATCACGGACAACAGCAAGACCATCATCGTGCACCTGAACGAGTCCGTGAAGATCGAGTGCACCCG
CCCGAGCAACAACACGCGCACCTCCATCCGGATCGGCCCTGGCCAGGCCTTCTACGCCACCGGCCAGGTGATCGGCAACATCCGCGAG
GCGCACTGCAACATCTCCGAGTCCAAGTGGAACGAGACCCTGCAGCGCGTGTCCGAGAAGCTGAAGGAGTACTTCCCCGACAAGAACA
TCACCTTCCAGCCGTCGTCCGGCGGCGACCTCGAGATCACCACGCACTCCTTCAACTGCGGTGGCGAGTTCTTCTACTGCAACACGTC
GTCCCTGTTCAACCGCACCTACATGGCGAACTCCACCGACATGGCCAACTCCACCGAGACGAACAGCACGCAGATCATCACGATCCAC
TGCCGCATCAAGCAGATCATCAACATGTGGCAGGAGGTGGGCCGCGCCATGTACGCACCGCCCATCGCCGGCAACATCACCTGCATCT
CCAACATCACCGGCCTCCTGCTGACCCGCGACGGCGGCAACAACACGGAGGACACGGAGACCTTCAGGCCAGTGGGAGGCAACATGAA
GGACAACTGGTCGTCCGAGCTGTACAAGTACAAGGTGGTGGAGGTGAAGCCCCTGGGCGTGGCACCCACCAACGCCcgcGAGcgcgtc
gtggagagggagaagGAGTAGTAAGgtgaccgaattcggatcc
>HV1300628
gtcgacaagaagccaccATGCGCGTGCGCGGCATCCAGCGCAGCTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCATCAACGCCACCAACGCGACGGCCTCGGACTCCAGCATCCTCGACGGGATGAAGAACTGCTCCTTC
AACATCACGACGGAGCTGCGCGACAAGCGCGAGAAGAAGAACGCCCTGTTCTACAAGCTGGACATCGTGCAGCTGGGCGGGAACTCCT
CGCAGTACAGGCTGATCAACTGCAACACCTCCGTCATCACGCAGGCGTGCCCCAAGGTGTCCTTCGACCCCATCCCCATCCACTACTG
CGCCCCGCCGGCTACGCCATCCTGAAGTGCAACAACAAGACCTTCAACGGCACCGGCCCGTGCAACAACGTGTCCACCGTGCAGTGC
ACGCACGGGATCAAGCCCGTGGTGTCCACGCAGCTGCTCCTGAACGGGTCGCTGGCCGAGGGCGAGATCATCATCCGGTCGAAGAACA
TCACGGACAACAGCAAGACCATCATCGTGCACCTGAACGAGTCCGTGAAGATCGAGTGCACCCGCCCGAGCAACAACACGCGCACCTC
CATCCGGATCGGCCCTGGCCAGGCCTTCTACGCCACCGGCCAGGTGATCGGCAACATCCGCGAGGCGCACTGCAACATCTCCGAGTCC
AAGTGGAACGAGACCCTGCAGCGCGTGTCCGAGAAGCTGAAGGAGTACTTCCCCGACAAGAACATCACCTTCCAGCCGTCGTCCGGCG
```

Fig. 16 (cont.)
GCGACCTCGAGATCACCACGCACTCCTTCAACTGCGGTGGCGAGTTCTTCTACTGCAACACGTCGTCCCTGTTCAACCGCACCTACAT
GGCGAACTCCACCGACATGGCCAACTCCACCGAGACGAACAGCACGCAGATCATCACGATCCACTGCCGCATCAAGCAGATCATCAAC
ATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAACAACACGGAGGACACGGAGACCTTCAGGCCAGTGGGAGGCAACATGAAGGACAACTGGTCGTCCGAGCTGTA
CAAGTACAAGGTGGTGGAGGTGAAGCCCCTGGGCGTGGCACCCACCAACGCCcgcGAGcgcgtcgtggagagggagaagGAGTAGTAA
Ggtcaccgaattcggatcc
>HV1300629
gtcgacaagaagccaccATGCGCGTGATGGGCAGGCAGCGCAACTACCCGCAGTGGTGGATCTGGAGCACGCTGGGCCTC
AGGATGCTCATGATCTGCAACGGCGTGCCGGTGTGGAAGGAGGCCAAGACGACCCTGTTCTGCGCGTCGGACGCCAAGGC
GTACGAGAAGGAGGTGCACAACGTGTGGGCGACCCACGCCTGCGTGCCCACGGACCCCAACCCGCAGGAGATGGTGCTGA
AGAACGTGACCGAGAACTTCAACATGTGGGAGAACGACATGGTGGACCAGATGCACGAGGACGTGATCTCCCTGTGGGAC
CAGTCCCTGAAGCCCTGCGTGAAGCTGACCCCGCTGTGCGTGACCCTGAACTGCACGGACGCCAACGCCACCGCGTCGAA
CGCCAACGCGACCGTGACCAACACGAACGCGACGGTGTCGAACGACTCCTCCATCATCGAGGAGATGAAGAACTGCTCCT
TCAACATCACGACGGAGCTGCGCGACAAGATCGAGAAGAAGTACGCCCTGTTCTACAAGCTGGACATCGTGCAGCTGGAC
GGCAACTCCACGCACTACCGCTTCATCAACTGCAACACCTCCGCGATCACGCAGGCGTGCCCCAAGGTGTCCTTCGACCC
CATCCCCATCCACTACTGCGCCCCCGCCGGCTACGCCATCCTGAAGTGCAACAACAAGACCTTCAACGGCACCGGCCCGT
GCAACAACGTGTCCACCGTGCAGTGCACGCACGGGATCAAGCCCGTGGTGTCCACGCAGCTGCTCCTGAACGGGTCGCTG
GCCGAGGGCGAGATCATCATCCGGTCGGAGAACATCACGGACAACGCGAAGACCATCATCGTGCACCTGAACGAGTCCGT
GAAGATCGAGTGCACCCGCCCGTCCAACAACACGCGCACCTCCATCGGGATCGGCCCTGGCCAGGCCTTCTACGCCACCG
GCCAGGTCATCGGCGACATCCGCAAGGCGCACTGCAACATCTCCGAGTCCAAGTGGAACGAGACCCTGCAGCGCGTGTCC
AAGAAGCTGAAGGAGTACTTCCCCGGCAAGAACATCACCTTCCAGCCGTCGTCCGGCGGCGACCCCGAAGTGACCACGCA
CTCCTTCAACTGCGGTGGCGAGTTCTTCTACTGCAACACGTCGTCCCTGTTCAACCGCACCTACATGACGAACAGCACGG
ACATGGCGAACTCCACCGAGACCAACCGCACCATCACGATCCACTGCCGCATCAAGCAGATCATCAACATGTGGCAGGAG
GTGGGCCGCGCCATGTACGCACCGCCCATCGCCGGCAACATCACCTGCATCTCCAACATCACCGGCCTCCTGCTGACCCG
CGACGGCGGCAACAACACGGACCCCGAGATCTTCAGGCCAGGCGGAGGCAACATGAAGGACAACTGGCGCTCCGAGCTGT
ACAAGTACAAGGTGGTGGAGGTGAAGCCCCTGGGCGTGGCACCCACCAACGCCCGCGAGCGCGTCGTGGAGCGCGAGAAG
GAGTAGTAAGgtaaccgaattcggatcc >HV1300749, CH505w020.2.D8gp120
gtcgacaagaagccaccATGCGCGTGATGGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACCAACGCCACCGCGAACAACTCCAACATCATCGAGGAGATGAAGAACTGCTCCTTCAACATCACG
ACGGAGCTGCGCGACAAGCGCGAGAAGAAGAACGCCCTGTTCTACAAGCTGGACATCGTGCAGCTGGACGGCAACTCCTCGCAGTACA
GGCTGATCAACTGCAACACCTCCGTCATCACGCAGGCGTGCCCCAAGGTGTCCTTCGACCCCATCCCCATCCACTACTGCGCCCCCGC
CGGCTACGCCATCCTGAAGTGCAACAACAAGACCTTCACCGGCACCGGCCCGTGCAACAACGTGTCCACCGTGCAGTGCACGCACGGG
ATCAAGCCCGTGGTGTCCACGCAGCTGCTCCTGAACGGGTCGCTGGCCGAGGGCGAGATCATCATCCGGTCCGAGAACATCACGAACA
ACGTGAAGACCATCATCGTGCACCTGAACGAGTCCGTGAAGATCGAGTGCACCCGCCCGAACAACAAGACGCGCACCTCCATCCGGAT
CGGCCCTGGCCAGGCCTTCTACGCCACCGGCGACATCATCGGCGACATCCGCAAGGCGCATTGCAACATCAGCAAGTCCAAGTGGAAC
GAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCGACATGGCCAACTC
CACCGAGACCAACTCCACGCGCACCATCACGATCCACTGCCGCATCAAGCAGATCATCAACATGTGGCAGGAGGTGGGCCGCGCCATG
TACGCACCGCCCATCGCCGGCAACATCACCTGCATCTCCAACATCACCGGCCTCCTGCTGACCCGCGACGGCGGCAAGAACAACACGG
AGACCTTCAGGCCAGGCGGAGGCAACATGAAGGACAACTGGCGCTCCGAGCTGTACAAGTACAAGGTGGTGGAGGTGAAGCCCCTGGG
CGTGGCACCCACCAACGCCCGCGAGCGCGTCGTGGAGCGCGAGAAGGAGTAGTAAGtggatcc
>HV1300777 gtcgacaagaagccaccATGCGCGTGATGGGCATCCAGCGCAACTACCCGCAGTGGTGGATCTGGTCGATGCTGGGCTTC
TGGATGCTCATGATCTGCAACGGCGTGCCGGTGTGGAAGGAGGCCAAGACGACCCTGTTCTGCGCGTCGGACGCCAAGGC
CTACGAGAAGGAGGTGCACAACGTGTGGGCGACCCACGCCTGCGTGCCCACGGACCCCAACCCGCAGGAGATGGTGCTGA
AGAACGTGACCGAGAACTTCAACATGTGGAAGAACGACATGGTGGACCAGATGCACGAGGACGTGATCTCCCTGTGGGAC
CAGTCCCTGAAGCCCTGCGTGAAGCTGACCCCGCTGTGCGTGACCCTGAACTGCACCAACGCCACCGCGTCCAACTCCTC
CATCATCGAGGGCATGAAGAACTGCTCCTTCAACATCACGACGGAGCTGCGCGACAAGCGCGAGAAGAACGCCCTGTGT
TCTACAAGCTGGACATCGTGCAGCTGGACGGCAACTCCTCGCAGTACAGGCTGATCAACTGCAACACCTCCGTCATCACG
CAGGCGTGCCCCAAGGTGTCCTTCGACCCCATCCCCATCCACTACTGCGCCCCCGCCGGCTACGCCATCCTGAAGTGCAA

Fig. 16 (cont.)

```
CAACAAGACCTTCACCGGCACCGGCCCGTGCAACAACGTGTCCACCGTGCAGTGCACGCACGGGATCAAGCCCGTGGTGT
CCACGCAGCTGCTCCTGAACGGGTCGCTGGCCGAGGGCGAGATCATCATCCGGTCCGAGAACATCACGAACAACGTGAAG
ACCATCATCGTGCACCTGAACGAGTCCGTGAAGATCGAGTGCACCCGCCCGAACAACAAGACGCGCACCTCCATCCGGAT
CGGCCCTGGCCAGGCCTTCTACGCCACCGGCCAGGTGATCGGCGACATCCGCGAGGCGTACTGCAACATCAACGAGTCCA
AGTGGAACGAGACCCTGCAGCGCGTGTCCAAGAAGCTGAAGGAGTACTTCCCCCACAAGAACATCACCTTCCAGCCGTCG
TCCGGCGGCGACCTCGAGATCACCACGCACTCCTTCAACTGCGGTGGCGAGTTCTTCTACTGCAACACGTCGTCGCTGTT
CAACCGCACCTACATGGCCAACTCCACCGACATGGCCAACTCCACCGAGACCAACTCCACGCGCACCATCACGATCCACT
GCCGCATCAAGCAGATCATCAACATGTGGCAGGAGGTGGGCCGCGCCATGTACGCACCGCCCATCGCCGGCAACATCACC
TGCATCTCCAACATCACCGGCCTCCTGCTGACCCGCGACGGCGGCAAGAACAACACGGAGACCTTCAGGCCAGGCGGAGG
CAACATGAAGGACAACTGGCGCTCCGAGCTGTACAAGTACAAGGTGGTGGAGGTGAAGCCCCTGGGCGTGGCACCCACCA
ACGTCCGCGAgcgcgtcgtggagcgcgagaagGAGTGATAGTAAGaacgtcggatcc

>HV1300778 gtcgacaagaagccaccATGCGCGTGATGGGCATCCAGCGCAACTACCCGCAGTGGTGGATCTGGTCGATGCTGGGCTTC
TGGATGCTCATGATCTGCAACGGCGTGCCGGTGTGGAAGGAGGCCAAGACGACCCTGTTCTGCGCGTCGGACGCCAAGGC
CTACGAGAAGGAGGTGCACAACGTGTGGGCGACCCACGCCTGCGTGCCCACGGACCCCAACCCGCAGGAGATGGTGCTGA
AGAACGTGACCGAGAACTTCAACATGTGGAAGAACGACATGGTGGACCAGATGCACGAGGACGTGATCTCCCTGTGGGAC
CAGTCCCTGAAGCCCTGCGTGAAGCTGACCCCGCTGTGCGTGACCCTGAACTGCACCAACCGCGACCAACGCCACCGGTC
CAACTCCTCCATCATCGAGGGCATGAAGAACTGCTCCTTCAACATCACGACGGAGCTGCGCGACAAGCGCGAGAAGAAGA
ACGCCCTGTTCTACAAGCTGGACATCGTGCAGCTGGACGGCAACTCCTCGCAGTACAGGCTGATCAACTGCAACACCTCC
GTCATCACGCAGGCGTGCCCCAAGGTGTCCTTCGACCCCATCCCCATCCACTACTGCGCCCCCGCCGGCTACGCCATCCT
GAAGTGCAACAACAAGACCTTCACCGGCACCGGCCCGTGCAACAACGTGTCCACCGTGCAGTGCACGCACGGGATCAAGC
CCGTGGTGTCCACGCAGCTGCTCCTGAACGGGTCGCTGGCCGAGGGCGAGATCATCATCCGGTCCGAGAACATCACGAAC
AACGACAAGACCATCATCGTGCACCTGAACGAGTCCGTGAAGATCGAGTGCACCCGCCCGAGCAACAAGACGCGCACCTC
CATCCGGATCGGCCCTGGCCAGGCCTTCTACGCCACCGGCCAGGTGATCGGCGACATCCGCGAGGCGTACTGCAACATCA
GCGAGTCCAAGTGGAACGAGACCCTGCAGCGCGTGTCCAAGAAGCTGAAGGAGTACTTCCCCCACAAGAACATCACCTTC
CAGCCGTCGTCCGGCGGCGACCTCGAGATCACCACGCACTCCTTCAACTGCGGTGGCGAGTTCTTCTACTGCAACACGTC
GTCGCTGTTCAACCGCACCTACATGGCCAACTCCACCGACATGGCCAACTCCACCGAGACCAACTCCACGCGCACCATCA
CGATCCACTGCCGCATCAAGCAGATCATCAACATGTGGCAGGAGGTGGGCCGCGCCATGTACGCACCGCCCATCGCCGGC
AACATCACCTGCATCTCCAACATCACCGGCCTCCTGCTGACCCGCGACGGCGGCAAGAACGACACGGAGACCTTCAGGCC
AGGCGGAGGCAACATGAAGGACAACTGGCGCTCCGAGCTGTACAAGTACAAGGTGGTGGAGGTGAAGCCCCTGGGCGTGG
CACCCACCAACGCCcgcGAgcgcgtcgtggagcgcgagaagGAGTGATAGTAAGaggtcccggtaaccggatcc

>HV1300779 gtcgacaagaagccaccATGCGCGTGATGGGCATCCAGCGCAACTACCCGCAGTGGTGGATCTGGTCGATGCTGGGCTTCTGGATGCT
CATGATCTGCAACGGCGTGCCGGTGTGGAAGGAGGCCAAGACGACCCTGTTCTGCGCGTCGGACGCCAAGGCCTACGAGAAGGAGGTG
CACAACGTGTGGGCGACCCACGCCTGCGTGCCCACGGACCCCAACCCGCAGGAGATGGTGCTGAAGAACGTGACCGAGAACTTCAACA
TGTGGAAGAACGACATGGTGGACCAGATGCACGAGGACGTGATCTCCCTGTGGGACCAGTCCCTGAAGCCCTGCGTGAAGCTGACCCC
GCTGTGCGTGACCCTGAACTGCACCGACGCCACCGCGTCCAACGCAACCGCGAGCAACGCCACGGCGTCGAACTCCTCCATCATCGAG
GAGATGAAGAACTGCTCCTTCAACATCACGACGGAGCTGCGCGACAAGCGCGAGAAGAAGAACGCCCTGTTCTACAAGCTGGACATCG
TGCAGCTGGACGGCAACTCCTCGCAGTACAGGCTGATCAACTGCAACACCTCCGCCATCACGCAGGCGTGCCCCAAGGTGTCCTTCGA
CCCCATCCCCATCCACTACTGCGCCCCCGCCGGCTACGCCATCCTGAAGTGCAACAACAAGACCTTCAACGGCACCGGCCCGTGCAAC
AACGTGTCCACCGTGCAGTGCACGCACGGGATCAAGCCCGTGGTGTCCACGCAGCTGCTCCTGAACGGGTCGCTGGCCGAGGGCGAGA
TCATCATCCGGTCCGAGAACATCACGGACAACGGGAAGACCATCATCGTGCACCTGAACGAGTCCGTGAAGATCGAGTGCACCCGCCC
GTCGAACAACACGCGCACCTCCATCCGGATCGGCCCTGGCCAGGCCTTCTACGCCACCGGCCAGGTGATCGGCGACATCCGCGAGGCG
CACTGCAACATCTCGGAGTCCAAGTGGAACGAGACCCTGCAGCGCGTGTCCAAGAAGCTGAAGGAGTACTTCCCCCACAAGAACATCA
CCTTCCAGCCGTCGTCCGGCGGCGACCTCGAGATCACCACGCACTCCTTCAACTGCGGTGGCGAGTTCTTCTACTGCAACACGTCGTC
GCTGTTCAACCGCACCTACATGGCCAACTCCACCGAGACCAACTCCACGCGCATCATCACGATCCACTGCCGCATCAAGCAGATCATC
AACATGTGGCAGGAGGTGGGCCGCGCCATGTACGCACCGCCCATCGCCGGCAACATCACCTGCATCTCCAACATCACCGGCCTCCTGC
TGACCCGCGACGGCGGCAACAACAACACGGAGACCTTCAGGCCAGGCGGAGGCAACATGAAGGACAACTGGCGCTCCGAGCTGTACAA
```

Fig. 16 (cont.)
GTACAAGGTGGTGGAGGTGAAGCCCCTGGGCGTGGCACCCACCAACGCCcgcGAgcgcgtcgtggagcgcgagaagGAGTGATAGTAA
Gaattcgggacctggatcc Fig. 17 (CH505 gp160 amino acid sequences)

>w000.TF
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNVKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w004.03
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNVKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLGYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w004.26
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNVKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTET
FRPGGGNMKDNWRSELYKYKVVEVKPLGVAPTNVRRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL

Fig. 17 (cont.)

```
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w004.10
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITKNVKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w014.3
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYVILKCNNKTFTGTGPCNNVSTVQCTHGIKPVVSTQLLLNG
SLAEGEIIIRSENITNNVKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSTRTIK
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILKFVLGICRAIRNIPTRIRQGFETALLZ
>w014.32
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNVKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSTRTIK
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILKFVLGICRAIRNIPTRIRQGFETALLZ
>w014.2
```

Fig. 17 (cont.)
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNVKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSTRTIT
IRCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w014.21
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNGKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSTRIIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQAKVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEDGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w014.10
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCITLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNGKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSTRIIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLSDTLAIAVGEGTDRILEFVLGICRAIRNIPTRIRQGFETALLZ
>w014.8
MRVMGIQRNYPQWWIWSMLGFWMLMICNGMWVTVYYGVPVWKEAKTTLFC
ASDAKAYEKEVHNVWATHACVPTDPNPQEMFLKNVTENFNMWKNDMVDQM
HEDVISLWDQSLKPCVKLTPLCVTLNCTNATASNSSIIERMKNCSFNITT
ELRDKREKKNALFYKLDIVQLDGNSSQYRLINCNTSVITQACPKVSFDPI Fig. 17 (cont.)
PIHYCAPAGYAILKCNNKTFTGTGPCNNVSTVQCTHGIKPVVSTQLLLNG
SLAEGEIIIRSENITNNVKTIIVHLNESVKIECTRPNNKTRASIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSTRTIT
IRCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w020.22
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATTSNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNVKTIIVHLNESVKIECTRPNNKTRTSIRIGPGQ
AFYATGQVIGDIREAYCNISESKWNETLQRVSKKLKEYFPHKNITFQPSS
GGDLEITTHSFNCGGEFFYCNTSSLFNRTYMANSTDMANSTETNSTRTIT
IRCRIKQIINMWQEVGRAMYAPPIAGNITCISNITGLLLTRDGGKNNTET
FRPGGGNMKDNWRSELYKYKVVEVKPLGAAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGGLVQYWGLELKRS
AISLLDTLAIAVGEGTDRILEFVLGICRAIRNIPTRIRQGFETALLZ
>w020.7
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNANASNNSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNGKTIIVHLNESVKIECTRPNNKTRTSIRIGPGQ
AFYATGQVIGDIREAYCNISESKWNETLQRVSKKLKEYFPHKNITFQPSS
GGDLEITTHSFNCGGEFFYCNTSSLFNRTYMANSTDMANSTETNSTRIIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFTLIAARAGELLGRSSLKGLRRGWEALKYLGSLVQYWGLELKRS
AISLLDTLAIAVGEGTDRILEFVLGICRAIRNIPTRIRQGFETALLZ
>w020.26
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNISIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNGKTIIVHLNESVKIECTRPNNKTRTSIRIGPGQ
AFYATGQVIGDIREAYCNISESKWNETLQRVSKKLKEYFPHKNITFQPSS
GGDLEITTHSFNCGGEFFYCNTSSLFNRTYMANSTDMANSTETNSTRIIT Fig. 17 (cont.)
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w020.4
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATANNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNGKTIIVHLNESVKIECTRPNNKTRTSIRIGPGQ
AFYATGQVIGDIREAYCNISESKWNETLQRVSKKLKEYFPHKNITFQPSS
GGDLEITTHSFNCGGEFFYCNTSSLFNRTYMANSTDMANSTETNSTRTIT
IRCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLRICRAIRNIPTRIRQGFETALLZ
>w020.8
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATANNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNAKTIIVHLNESVKIECTRPNNKTRTSIRIGPGQ
AFYATGQVIGNIREAYCNISESKWNETLQRVSKKLKEYFPHKNITFQPSS
GGDLEITTHSFNCGGEFFYCNTSSLFNRTYMANSTDMANSTETNSTRTIT
LHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w020.14
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNNSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNAKTIIVHLNESVKIECTRPNNKTRTSIRIGPGQ
AFYATGQVIGDIRKAYCNISESKWNETLQRVSKKLKEYFPHKNITFQPSS
GGDLEITTHSFNCGGEFFYCNTSSLFNRTYMANSTDMANSTETNSTRTIT
LHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK

Fig. 17 (cont.)
```
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w020.15
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATTSNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNVKTIIVHLNESVKIECTRPNNKTRTSIRIGPGQ
AFYATGQVIGDIREAYCNISESKWNETLQRVSKKLKEYFPHKNITFQPSS
GGDLEITTHSFNCGGEFFYCNTSSLFNRTYMANSTDMANSTETNNTRTIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w020.11
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATTSNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNVKTIIVHLNESVKIECTRPNNKTRTSIRIGPGQ
AFYATGQVIRNIREAYCNINESKWNETLQRVSKKLKEYFPHKNITFQPSS
GGDLEITTHSFNCGGEFFYCNTSSLFNRTYMANSTDMANSTETNSTRTIK
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w020.23
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATTSNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNAKTIIVHLNESVKIECTRPNNKTRTSIRIGPGQ
AFYATGQVIGDIRKAYCNINESKWNETLQRVSKKLKEYFPHKNITFQPSS
GGDLEITTHSFNCGGEFFYCNTSSLFNRTYMANSTDMANSTETNNTRTIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRRGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
```

Fig. 17 (cont.)
AISLLDTLAIAVGEGTDRILEFVLGICRAIRNIPTRIRQGFETALLZ
>w020.24
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATTSNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNAKTIIVHLNESVKIECTRPNNKTRTSIRIGPGQ
AFYATGQVIGDIRKAYCNINESKWNETLQRVSKKLKEYFPHKNITFQPSS
GGDLEITTHSFNCGGEFFYCNTSSLFNRTYMANSTDMANSTETNSTRTIT
IRCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALAWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w020.9
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNAASNSSIIEGMKNCSFNITTE
LRDKREKKNALFYKLDIVQLDGNSSQYRLINCNTSVITQACPKVSFDPIP
IHYCAPAGYAILKCNNKTFTGTGPCNNVSTVQCTHGIKPVVSTQLLLNGS
LAEGEIIIRSENITNNAKTIIVHLNESVKIECTRPNNKTRTSIRIGPGQA
FYATGQVIGDIRKAYCNINESKWNETLQRVSKKLKEYFPHKNITFQPSSG
GDLEITTHSFNCGGEFFYCNTSSLFNRTYMANSTDMANSTETNNTRTITI
HCRIKQIINMWQEVGRAMYAPPIAGNITCISNITGLLLTRDGGKNNTETF
RPGGGNMKDNWRSELYKYKVVEVKPLGVAPTNARRRVVEREKRAVGMGAV
FLGFLGAAGSTMGAASITLTVQARQLLSGIVQQQSNLLKAIEAQQHMLKL
TVWGIKQLQARVLALERYLKDQQLLGMWGCSGKLICTTNVYWNSSWSNKT
YGDIWDNMTWMQWEREISNYTEIIYELLEESQNQQEKNEQDLLALDRWNS
LWNWFNITNWLWYIKIFIMIVGGLIGLRIIFAVLSLVNRVRQGYSPLSLQ
TLIPSPRGPDRPGGIEEEGGEQDRNRSTRLVSGFLALAWDDLRSLCLFIY
HRLRDFILIAARAGELLGRSSLKGLRRGWEALKYLGSLVQYWGLELKRSA
ISLLDTLAIAVGEGTDRILEFVLGICRAIRNIPTRIRQGFETALLZ
>w020.19
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNATASNSSIIEGMKNCS
FNITTELRDKREKKNALFYKLDIVQLDGNSSQYRLINCNTSVITQACPKV
SFDPIPIHYCAPAGYAILKCNNKTFTGTGPCNNVSTVQCTHGIKPVVSTQ
LLLNGSLAEGEIIIRSENITNNVKTIIVHLNESVKIECTRPNNKTRKSIR
IGPGQAFYATGQVIGDIREAYCNISESKWNETLQRVSKKLKEYFPHKNIT
FQPSSGGDLEITTHSFNCGGEFFYCNTSSLFNRTYMANSTDMANSTETNS
TRTITIRCRIKQIINMWQEVGRAMYAPPIAGNITCISNITGLLLTRDGGK
NNTETFRPGGGNMKDNWRSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYGDIWDNMTWMQWEREISNYTEIIYELLEESQNQQEKNEQDLLA
LDRWNSLWNWFNITNWLWYIKIFIMIVGGLIGLRIIFAVLSLVNRVRQGY
SPLSLQTLIPSPRGPDRPGGIEEEGGEQDRNRSTRLVSGFLALVWDDLRS
LCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETAL
LZ
>w020.13
MRVMGIQRNYPQWWIWSMLGFWMLMICNGMWVTVYYGVPVWKEAKTTLFC Fig. 17 (cont.)
ASDAKAYEKEVHNVWATHACVPTDPNPQEMVLKNVTENFNMWKNDMVDQM
HEDVISLWDQSLKPCVKLTPLCVTLNCTNATASNATASNSSIIEGMKNCS
FNITTELRDKREKKNALFYKLDIVQLDGNSSQYRLINCNTSVITQACPKV
SFDPIPIHYCAPAGYAILKCNNKTFTGTGPCNNVSTVQCTHGIKPVVSTQ
LLLNGSLAEGEIIIRSENITNNVKTIIVHLNESVKIECTRPNNKTRKSIR
IGPGQAFYATGQVIGDIREAYCNINESKWNETLQRVSKKLKEYFPHKNIT
FQPSSGGDLEITTHSFNCGGEFFYCNTSSLFNRTYMANSTDMANSTETNS
TRTITIRCRIKQIINMWQEVGRAMYAPPIAGNITCISNITGLLLTRDGGK
NNTETFRPGGGNMKDNWRSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYGDIWDNMTWMQWEREISNYTEIIYELLEESQNQQEKNEQDLLA
LDRWNSLWNWFNITNWLWYIKIFIMIVGGLIGLRIIFAVLSLVNRVRQGY
SPLSLQTLIPSPRGPDRPGGIEEEGGEQDRNRSTRLVSGFLALVWDDLRS
LCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETAL
LZ
>w020.3
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNTNATASNSSTIEGMKN
CSFNITTELRDKREKKNALFYKLDIVQLDGNSSQYRLINCNTSVITQACP
KVSFDPIPIHYCAPAGYAILKCNNKTFTGTGPCNNVSTVQCTHGIKPVVS
TQLLLNGSLAEGEIIIRSENITNNAKTIIVHLNESVKIECTRPNNKTRTS
IRIGPGQAFYATGQVIGNIREAYCNISESKWNETLQRVSKKLKEYFPHKN
ITFQPSSGGDLEITTHSFNCGGEFFYCNTSSLFNRTYMANSTDMANSTET
NSTRIITIHCRIKQIINMWQEVGRAMYAPPIAGNITCISNITGLLLTRDG
GKNNTETFRPGGGNMKDNWRSELYKYKVVEVKPLGVAPTNARRRVVEREK
RAVGMGAVFLGFLGAAGSTMGAASITLTVQARQLLSGIVQQQSNLLKAIE
AQQHMLKLTVWGIKQLQARVLALERYLKDQQLLGMWGCSGKLICTTNVYW
NSSWSNKTYGDIWDNMTWIQWEREISNYTEIIYELLEESQNQQEKNEQDL
LALDRWNSLWNWFNITNWLWYIKIFIMIVGGLIGLRIIFAVLSLANRVRQ
GYSPLSLQTLIPSPRGPDRPGGIEEEGGEQDRNRSTRLVSGFLALVWDDL
RSLCLFIYHRLRDFILIAARAGELLGRSSLKGLRRGWEALKYLGSLVQYW
GLELKRSAISLLDTLAIAVGEGTDRILEFVLGICRAIRNIPTRIRQGFET
ALLZ
>w030.11
MRVMGIQRNYPQWWIWSMLGFWMLMICKGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNISXIEEMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITDNVKTIIVHLNESVKIECTRPNNKTRTSIRIGPGQ
AFYATGQVIGDIREAYCNISESKWNETLQRVSKKLKEYFPHKNITFQPSS
GGDLEITTHSFNCGGEFFYCNTSSLFNRTYMANSTETNSTRTITIRCRIK
QIINMWQEVGRAMYAPPIAGNITCISNITGLLLTRDGGKNNTDTETFRPG
GGNMKDNWRSELYKYKVVEVKPLGVAPTNARRRVVEREKRAVGMGAVFLG
FLGAAGSTMGAASITLTVQARQLLSGIVQQQSNLLKAIEAQQHMLKLTVW
GIKQLQARVLALERYLKDQQLLGMWGCSGKLICTTNVYWNSSWSNKTYGD
IWDNMTWMQWEREISNYTEIIYELLEESQNQQEKNEQDLLALDRWNSLWN
WFNITNWLWYIKIFIMIVGGLIGLRIIFAVLSLVNRVRQGYSPLSLQTLI
PSPRGPDRPGGIEEEGGEQDRNRSTRLVSGFLALVWDDLRSLCLFIYHRL
RDFILIAARAGELLGRSSLKGLRRGWEALKYLGSLVQYWGLELKRSAISL
LDTLAIAIGEGTDRILEFVLGICRAIRNIPTRIRQGFETALLZ
>w030.20
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATTNATASNSSIIEGMKNCSF Fig. 17 (cont.)
NITTELRDKREKKNALFYKLDIVQLDGNSSQYRLINCNTSVITQACPKVS
FDPIPIHYCAPAGYAILKCNNKTFTGTGPCNNVSTVQCTHGIKPVVSTQL
LLNGSLAEGEIIIRSENITNNAKTIIVHLNESVKIECTRPNNKTRTSIRI
GPGQAFYATGQVIGDIREAYCNISESKWNETLQRVSKKLKEYFPHKNITF
QPSSGGDLEITTHSFNCGGEFFYCNTSSLFNRTYMANSTDMANSTETNST
RIITIHCRIKQIINMWQEVGRAMYAPPIAGNITCISNITGLLLTRDGGKN
TRDGGKNNTETFRPGGGNMKDNWRSELYKYKVVEVKPLGVAPTNARRRVV
EREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTT
NVYWNSSWSNKTYGDIWDNMTWMQWEREISNYTEIIYELLEESQNQQEKN
EQDLLALDRWNSLWNWFNITNWLWYIKIFIMIVGGLIGLRIIFAVLSLVN
RVRQGYSPLSLQTLIPSPRGPDRPGGIEEEGGEQDRNRSTRLVSGFLALA
WDDLRSLCLFIYHRLRDFILIAARAGELLGRSSLKGLRRGWEALKYLGSL
VQYWGLELKRSAISLLDTLAIAVGEGTDRILEFVLGICRAIRNIPTRIRQ
GFETALLZ
>w030.17
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATNATASNSSIIEGMKNCSFN
ITTELRDKREKKNALFYKLDIVQLDGNSSQYRLINCNTSVITQACPKVSF
DPIPIHYCAPAGYAILKCNNKTFTGTGSCNNVSTVQCTHGIKPVVSTQLL
LNGSLAEGEIIIRSENITDNGKTIIVHLNESVKIECTRPNNKTRTSIRIG
PGQAFYATGQVIGDIKEAYCNISESKWNETLQRVSKKLKEYFPHKNITFQ
PSSGGDLEITTHSFNCGGEFFYCNTSSLFNRTYMANSTDMANSTETNSTR
NITIHCRIKQIINMWQEVGRAMYAPPIAGNITCISNITGLLLTRDGGKNN
TDTETFRPGGGNMKDNWRSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYGDIWDNMTWMQWEREISNYTEIIYELLEESQNQQEKNEQDLLA
LDRWNSLWNWFNITNWLWYIKIFIMIVGGLRIIFAVLSLVNRVRQGY
SPLSLQTLIPSPRGPDRPGGIEEEGGEQDRNRSTRLVSGFLALVWDDLRS
LCLFIYHRLRDFILIAARAGELLGRSSLKGLRRGWEALKYLGSLVQYWGL
ELKRSAISLLDTLAIAIGEGTDRILEFVLGICRAIRNIPTRIRQGFETAL
LZ
>w030.6
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATTNATASNSSIIEGMKNCSF
NITTELRDKREKKNALFYKLDIVQLDGNSSQYRLINCNTSVITQACPKVS
FDPIPIHYCAPAGYAILKCNNKTFTGTGPCNNVSTVQCTHGIKPVVSTQL
LLNGSLAEGEIIIRSENITNNAKTIIVHLNESVKIECTRPSNKTRTSIRI
GPGQAFYATGQVIGDIREAYCNISESKWNETLQRVSKKLKEYFPHKNITF
QPSSGGDLEITTHSFNCGGEFFYCNTSSLFNRTYMANSTDMANSTETNST
RTITIRCRIKQIINMWQEVGRAMYAPPIAGNITCISNITGLLLTRDGGKN
NTDTETFRPGGGNMKDNWRSELYKYKVVEVKPLGVAPTNARRRVVEREKR
AVGMGAVFLGFLGAAGSTMGAASITLTVQARQLLSGIVQQQSNLLKAIEA
QQHMLKLTVWGIKQLQARVLALERYLKDQQLLGMWGCSGKLICTTNVYWN
SSWSNKTYGDIWDNMTWMQWEREISNYTEIIYELLEESQNQQEKNEQDLL
ALDRWNSLWNWFNITNWLWYIKVFIMIVGGLIGLRIIFAVLSLVNRVRQG
YSPLSLQTLIPSPRGPDRPGGIEEEGGEQDRNRSTRLVSGFLALVWDDLR
SLCLFIYHRLRDFILIAARAGELLGRSSLKGLRRGWEALKYLGSLVQYWG
LELKRSAISLLDTLAITVGEGTDRILEFVLGICRAIRNIPTRIRQGFETA
LLZ
>w030.25
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATTNATASNSSIIEGMKNCSF
NITTELRDKREKKNALFYKLDIVQLDGNSSQYRLINCNTSVITQACPKVS Fig. 17 (cont.)
FDPIPIHYCAPAGYAILKCNNKTFTGTGPCNNVSTVQCTHGIKPVVSTQL
LLNGSLAEGEIIIRSENITNNAKTIIVHLNESVKIECTRPNNKTRTSIRI
GPGQAFYATGQVIGDIREAHCNISESKWNETLQRVSKKLKEYFPHKNITF
QPSSGGDLEITTHSFNCGGEFFYCNTSSLFNRTYMANSTDMANSTETNST
RTITIRCRIKQIINMWQEVGRAMYAPPIAGNITCISNITGLLLTRDGGKN
NTDTETFRPGGGNMKDNWRSELYKYKVVEVKPLGVAPTNARRRVVEREKR
AVGMGAVFLGFLGAAGSTMGAASITLTVQARQLLSGIVQQQSNLLKAIEA
QQHMLKLTVWGIKQLQARVLALERYLKDQQLLGMWGCSGKLICTTNVYWN
SSWSNKTYGDIWDNMTWMQWEREISNYTEIIYELLEESQNQQEKNEQDLL
ALDRWNNLWNWFNITNWLWYIKIFIMIVGGLIGLRIIFAVLSLVNRVRQG
YSPLSLQTLIPSPRGPDRPGGIEEEGGEQDRNRSTRLVSGFLALVWDDLR
SLCLFIYHRLRDFILIAARAGELLGRSSLKGLRRGWEALKYLGSLVQYWG
LELKRSAISLLDTLAIAVGEGTDRILEFVLGICRAIRNIPTRIRQGFETA
LLZ
>w030.21
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATTNATASNSSIIEEMKNCSF
NITTELRDKREKKNALFYKLDIVQLDGNSSQYRLINCNTSVITQACPKVS
FDPIPIHYCAPAGYAILKCNNKTFTGTGPCNNVSTVQCTHGIKPVVSTQL
LLNGSLAEGEIIIRSENITNTAKTIIVHLNESVKIECTRPNNKTRTSIRI
GPGQAFYATGQVIGDIREAYCNISESKWNETLQRVSKKLKEYFPHKNITF
QPSSGGDLEITTHSFNCGGEFFYCNTSSLFNRTYMANSTDMANSTETNST
RTITIRCRIKQIINMWQEVGRAMYAPPIAGNITCISNITGLLLTRDGGEN
NTETFRPGGGNMKDNWRSELYKYKVVEVKPLGVAPTNARRRVVEREKRAV
GMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSS
WSNKTYGDIWDNMTWMQWEREISNYTEIIYELLEESQNQQEKNEQDLLAL
DRWNSLWNWFNITNWLWYIKIFIMIVGGLIGLRIIFAVLSLVNRVRQGYS
PLSLQTLIPSPRGPDRPGGIEEEGGEQDRNRSTRLVSGFLALVWDDLRSL
CLFIYHRLRDFILIAARAGELLGRSSLKGLRRGWEALKYLGSLVQYWGLE
LKRSAISLLDTLAIAVGEGTDRILEFVLGICRAIRNIPTRIRQGFETALL
Z
>w030.18
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATANATASNSSIIEGMKNCSF
NITTELRDKREKKNALFYKLDIVQLDGNSSQYRLINCNTSVITQACPKVS
FDPIPIHYCAPAGYAILKCNNKTFTGTGPCNNVSTVQCTHGIKPVVSTQL
LLNGSLAEGEIIIRSENITNNAKTIIVHLNESVKIECTRPNNKTRTSIRI
GPGQAFYATGQVIGDIREAYCNISESKWNETLQRVSKKLKEYFPHKNITF
QPSSGGDLEITTHSFNCGGEFFYCNTSSLFNRTYMANSTDMANSTETNST
RIITIHCRIKQIINMWQEVGRAMYAPPIAGNITCISNITGLLLTRDGGKN
NPETFRPGGGNMKDNWRSELYKYKVVEVKPLGVAPTNARRRVVEREKRAV
GLGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSS
WSNKTYGDIWDNMTWMQWEREISNYTEIIYELLEESQNQQEKNEQDLLAL
DRWNSLWNWFNITNWLWYIKIFIMIVGGLIGLRIIFAVLSLVNRVRQGYS
PLSLQTLIPSPRGPDRPGGIEEEGGEQDRNRSTRLVSGFLALVWDDLRSL
CLFIYHRLRDFILIAARAGELLGRSSLKGLRRGWEALKYLGSLVQYWGLE
LKRSAISLLDTLAIVVGEGTDRILEFVLGICRAIRNIPTRIRQGFETALL
Z
>w030.9
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATANATASNSSIIEGMKNCSF
NITTELRDKREKKNALFYKLDIVQLDGNSSQYRLINCNTSVITQACPKVS
FDPIPIHYCAPAGYAILKCNNKTFNGTGPCNNVSTVQCTHGIKPVVSTQL

Fig. 17 (cont.)
LLNGSLAEGEIIIRSENITNNVKTIIVHLNESVKIECTRPNNKTRTSIRI
GPGQAFYATGQVIGDIREAHCNISESKWNKTLQRVSKKLKEYFPHKNITF
QPSSGGDLEITTHSFNCGGEFFYCNTSSLFNRTYMANSTDMANSTETNST
RTITIRCRIKQIINMWQEVGRAMYAPPIAGNITCISNITGLLLTRDGGKN
NTDTETFRPGGGNMKDNWRSELYKYKVVEVKPLGVAPTNARRRVVEREKR
AVGMGAVFLGFLGAAGSTMGAASITLTVQARQLLSGIVQQQSNLLKAIEA
QQHMLKLTVWGIKQLQARVLALERYLKDQQLLGMWGCSGKLICTTNVYWN
SSWSNKTYGDIWDNMTWMQWEREISNYTEIIYELLEESQNQQEKNEQDLL
ALDRWNSLWNWFNITNWLWYIKIFIMIVGGLIGLRIIFAVLSLVNRVRQG
YSPLSLQTLIPSPRGPDRPGGIEEEGGEQDRNRSTRLVSGFLALVWDDLR
SLCLFIYHRLRDFILIAARAGELLGRSSLKGLRRRWEALKYLGSLVQYWG
LELKRSAISLLDTLAIAIGEGTDRILEFVLGICRAIRNIPTRIRQGFETA
LLZ
>w030.36
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATANATASNSSIIEGMKNCSF
NITTELRDKREKKNALFYKLDIVQLDGNSSQYRLINCNTSVITQACPKVS
FDPIPIHYCAPAGYAILKCNNKTFNGTGPCNNVSTVQCTHGIKPVVSTQL
LLNGSLAEGEIIIRSENITNNVKTIIVHLNESVKIECTRPNNKTRTSIRI
GPGQAFYATGQVIGDIREAYCNISESKWNETLQRVSKKLKEYFPHKNITF
QPSSGGDLEITTHSFNCGGEFFYCNTSSLFNRTYMANSTDMANSTETNST
RTIKIHCRIKQIINMWQEVGRAMYAPPIAGNITCISNITGLLLTRDGGKN
NTDTETFRPGGGNMKDNWRSELYKYKVVEVKPLGVAPTNARRRVVEREKR
AVGMGAVFLGFLGAAGSTMGAASITLTVQARQLLSGIVQQQSNLLKAIEA
QQHMLKLTVWGIKQLQARVLALERYLKDQQLLGMWGCSGKLICTTNVYWN
SSWSNKTYGDIWDNMTWMQWEREISNYTEIIYELLEESQNQQEKNEQDLL
ALDRWNSLWNWLNITNWLWYIKIFIMIVGGLIGLRIIFAVLSLVNRVRQG
YSPLSLQTLIPSPRGPDRPGGIEEEGGEQDRNRSTRLVSGFLALVWDDLR
SLCLFIYHRLRDFILIAARAGELLGRSSLKGLRRGWEALKYLGSLVQYWG
LELKRSAISLLDTLAIAVGEGTDRILEFVLGICRAIRNIPTRIRQGFETA
LLZ
>w030.5
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATANATASNSSIIEGMKNCSF
NITTELRDKREKKNALFYKLDIVQLDGNSSQYRLINCNTSVITQACPKVS
FDPIPIHYCAPAGYAILKCNNKTFTGTGPCNNVSTVQCTHGIKPVVSTQL
LLNGSLAEGEIIIRSENITNNGKTIIVQLNESVKIECTRPNNKTRTSIRI
GPGQAFYATGQVIGNIREAYCNISESKWNETLQRVSKKLKEYFPHKNITF
QPSSGGDLEITTHSFNCGGEFFYCNTSSLFNRTYMANSTDMANSTETNST
RIITIHCRIKQIINMWQEVGRAMYAPPIAGNITCISNITGLLLTRDGGKN
NTDTETFRPGGGNMKDNWRSELYKYKVVEVKPLGVAPTNARRRVVEREKR
AVGMGAVFLGFLGAAGSTMGAASITLTVQARQLLSGIVQQQSNLLKAIEA
QQHMLKLTVWGIKQLQARVLALERYLKDQQLLGMWGCSGKLICTTNVYWN
SSWSNKTYGDIWDNMTWMQWEREISNYTEIIYELLEESQNQQEKNEQDLL
ALDRWNSLWNWFNITNWLWYIKIFIMIVGGLIGLRIIFAVLSLVNRVRQG
YSPLSLQTLIPSPRGPDRPGGIEEEGGEQDRNRSTRLVSGFLALVWDDLR
SLCLFIYHRLRDFILIAARAGELLGRSSLKGLRRGWEALKYLGSLVQYWG
LELKRSAISLLDTLAIAVGEGTDRILEFVLGICRAIRNIPTRIRQGFETA
LLZ
>w030.27
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNATASNSSIIEGMKNCS
FNITTELRDKREKKNALFYKLDIVQLDGNSSQYRLINCNTSVITQACPKV
SFDPIPIHYCAPAGYAILKCNNKTFTGTGPCNNVSTVQCTHGIKPVVSTQ
LLLNGSLAEGEIIIRSENITNNVKTIIVHLNESVKIECTRPNNKTRTSIR Fig. 17 (cont.)
IGPGQAFYATGQVIGNIREAYCNISESKWNETLQRVSKKLKEYFPHKNIT
FQPSSGGDLEITTHSFNCGGEFFYCNTSSLFNRTYMANSTDMANSTETNS
TRIITIHCRIKQIINMWQEVGRAMYAPPIAGNITCISNITGLLLTRDGGK
NNTDTETFRPGGGNMKDNWRSELYKYKVVEVKPLGVAPTNARRRVVEREK
RAVGMGAVFLGFLGAAGSTMGAASITLTVQARQLLSGIVQQQSNLLKAIE
AQQHMLKLTVWGIKQLQARVLALERYLKDQQLLGMWGCSGKLICTTNVYW
NSSWSNKTYGDIWDNMTWMQWEREISNYTEIIYELLEESQNQQEKNEQDL
LALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDL
RSLCLFIYHRLRDFILIAARAGELLGRSSLKGLRRGWEALKYLGSLVQYW
GLELKRSAISLLDTLAIAVGEGTDRILEFVLGICRAIRNIPTRIRQGFET
ALLZ
>w030.23
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNATASNSSIIEGMKNCS
FNITTELRDKREKKNALFYKLDIVQLDGNSSQYRLINCNTSVITQACPKV
SFDPIPIHYCAPAGYAILKCNNKTFTGTGPCNNVSTVQCTHGIKPVVSTQ
LLLNGSLAEGEIIIRSENITNNGKTIIVHLNESVKIECTRPSNKTRTSIR
IGPGQAFYATGQVIGDIREAHCNISESKWNETLQRVSKKLKEYFPHKNIT
FQPSSGGDLEITTHSFNCGGEFFYCNTSSLFNRTYMANSTDMANSTETNS
TRTITLHCRIKQIINMWQEVGRAMYAPPIAGNITCISNITGLLLTRDGGK
NNTDTETFRPGGGNMKDNWRSELYKYKVVEVKPLGVAPTNARRRVVEREK
RAVGMGAVFLGFLGAAGSTMGAASITLTVQARQLLSGIVQQQSNLLKAIE
AQQHMLKLTVWGIKQLQARVLALERYLKDQQLLGMWGCSGKLICTTNVYW
NSSWSNKTYGDIWDNMTWMQWEREISNYTEIIYELLEESQNQQEKNEQDL
LALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDL
RSLCLFIYHRLRDFILIAARAGELLGRSSLKGLRRGWEALKYLGSLVQYW
GLELKRSAISLLDTLAIAVGEGTDRILEFVLGICRAIRNIPTRIRQGFET
ALLZ
>w030.15
MRVMGIQRNYPQWWIWSMLGFWMLMICNGMWVTVYYGVPVWKEAKTTLFC
ASDAKAYEKEVHNVWATHACVPTDPNPQEMGLKNVTENFNMWKNDMVDQM
HEDVISLWDQSLKPCVKLTPLCVTLNCTNATASNATASNSSIIEGMKNCS
FNITTELRDKREKKNALFYKLDIVQLDGNSSQYRLINCNTSVITQACPKV
SFDPIPIHYCAPAGYAILKCNNKTFTGTGPCNNVSTVQCTHGIKPVVSTQ
LLLNGSLAEGEIIIRSENITNNGKTIIVHLNESVKIECTRPNNKTRTSIR
IGPGQAFYATGQVIGDIREAHCNISESKWNETLQRVSKKLKEYFPHQNIT
FQPSSGGDLEITTHSFNCGGEFFYCNTSSLFNRTYMANSTDMANSTETNS
TRTITIRCRIKQIINMWQEVGRAMYAPPIAGNITCISNITGLLLTRDGGK
NNTDTETFRPGGGNMKDNWRSELYKYKVVEVKPLGVAPTNARRRVVEREK
RAVGMGAVFLGFLGAAGSTMGAASITLTVQARQLLSGIVQQQSNLLKAIE
AQQHMLKLTVWGIKQLQARVLALERYLKDQQLLGMWGCSGKLICTTNVYW
NSSWSNKTYGDIWDNMTWMQWEREISNYTEIIYELLEESQNQQEKNEQDL
LALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDL
RSLCLFIYHRLRDFILITARAGELLGRSSLKGLRRGWEALKYLGSLVQYW
GLELKRSAISLLDTLAIAVGEGTDRILEFVLGICRAIRNIPTRIRQGFET
ALLZ
>w030.10
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATTSNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNDKTIIVHLNESVKIECTRPNNNTRTSIRIGPGQ
AFYATGQVIGDIREAYCNISESKWNETLQRVSKKLKEYFPHKNITFQPSS Fig. 17 (cont.)
GGDLEITTHSFNCGGEFFYCNTSSLFNRTYMANSTDMANSTETNSTRIIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w030.28
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKMTPLCVTLNCTNATAINSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNDKTIIVHLNESVKIECTRPNNKTRTSIRIGPGQ
AFYATGQVIGDIREAHCNISESKWNETLQRVSKKLKEYFPHKNITFQPSS
GGDLEITTHSFNCGGEFFYCNTSSLFNRTYMANSTDMANSTETNSTRTIT
IRCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
SYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w030.13
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKMTPLCVTLNCTNATAINSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNDKTIIVHLNESVKIECTRPNNKTRTSIRIGPGQ
AFYATGQVIGDIREAYCNISESKWNETLQRVSKKLKEYFPHKNITFQPSS
GGDLEITTHSFNCGGEFFYCNTSSLFNRTYMANSTDMANSTETNSTRTPIT
IHCRIKQIINMWQEVGRAMYAPPIAGNITCISNITGLLLTRDGGKNNTET
FRPGGGNMKDNWRSELYKYKVVEVKPLGIAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w030.19
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATARNCTNATASNSSIIEGMK
NCSFNITTELRDKREKKNALFYKLDIVQLDGNSSQYRLINCNTSVITQAC
PKVSFDPIPIHYCAPAGYAILKCNNKTFTGTGPCNNVSTVQCTHGIKPVV
STQLLLNGSLAEGEIIIRSENITNSGKTIIVHLNESVKIECTRPNNKTRT
SIRIGPGQAFYATGQVIGDIREAYCNISESKWNETLQRVSKKLKEYFPHK
NITFQPSSGGDLEITTHSFNCGGEFFYCNTSSLFNRTYMANSTDMANSTE
TNSTRIITIHCRIKQIINMWQEVGRAMYAPPIAGNITCISSITGLLLTRD
GGENNTETFRPGGGNMKDNWRSELYKYKVVEVKPLGVAPTNARRRVVERE
KRAVGMGAVFLGFLGAAGSTMGAASITLTVQARQLLSGIVQQQSNLLKAI

Fig. 17 (cont.)
EAQQHMLKLTVWGIKQLQARVLALERYLKDQQLLGMWGCSGKLICTTNVY
WNSSWSNKTYGDIWDNMTWMQWEREISNYTEIIYELLEESQNQQEKNEQD
LLALDRWNSLWNWFNITNWLWYIKIFIMIVGGLIGLRIIFAVFSLVNRVR
QGYSPLSLQTLIPSPRGPDRPGGIEEEGGEQDRNRSTRLVSGFLALVWDD
LRSLCLFIYHRLRDFILIAARAGELLGRSSLKGLRRGWEALKYLGSLVQY
WGLELKRSAISLLDTLAIAVGEGTDRILEFVLGICRAIRNIPTRIRQGFE
TALLZ
>w053.3
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATNATASNSSILEGMKNCSFN
ITTELRDKREKKNALFYKLDIVQLDGNSSQYRLINCNTSVITQACPKVSF
DPIPIHYCAPAGYAILKCNNKTFNGTGPCNNVSTVQCTHGIKPVVSTQLL
LNGSLAEGEIIIRSENITDNGKTIIVHLNESVKIECTRPSNNTRTSIRIG
PGQAFYATGQVIGDIREAHCNISESKWNETLQRVSKKLKEYFPHKNITFQ
PSSGGDLEITTHSFNCGGEFFYCNTSSLFNRTYMANSTETNSTRTITLHC
RIKQIINMWQEVGRAMYAPPIAGNITCISNITGLLLTRDGGKNNTETFET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALAWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>w053.29
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTDATASNATAINSSIIEGMKNCS
FNITTELRDKREKKNALFYKLDIVQLDGNSSQYRLINCNTSVITQACPKV
SFDPIPIHYCAPAGYAILKCNNKTFNGTGPCNNVSTVQCTHGIKPVVSTQ
LLLNGSLAEGEIIIRSENITNNAKTIIVHLNESVKIECTRPSNNTRTSIR
IGPGQAFYATGQVIGDIREAHCNISESKWNETLQRVSKKLKEYFPHKNIT
FQPSSGGDLEITTHSFNCGGEFFYCNTSSLFNRTYMANSTETNSTRIITI
RCRIKQIINMWQEVGRAMYAPPIAGNITCISNITGLLLTRDGGKNNTETF
ETFRPEGGNMKDNWRSELYKYKVVEVKPLGVAPTNARRRVVEREKRAVGM
GAVFLGFLGAAGSTMGAASITLTVQARQLLSGIVQQQSNLLKAIEAQQHM
LKLTVWGIKQLQARVLALERYLKDQQLLGMWGCSGKLICTTNVYWNSSWS
NKTYGDIWDNMTWMQWEREISNYTEIIYELLEESQNQQEKNEQDLLALDR
WNSLWNWFNITNWLWYIKIFIMIVGGLIGLRIIFAVLSLVNRVRQGYSPL
SLQTLIPSPRGPDRPGGIEEEGGEQDRNRSTRLVSGFLALAWDDLRSLCL
FIYHRLRDFILIAARAGELLGRSSLKGLRRGWEALKYLGSLVQYWGLELK
RSAISLLDTLAIAVGEGTDRILEFVLGICRAIRNIPTRIRQGFETALLZ
>w053.6
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATNATASNSSILEGMKNCSFN
ITTELRDKREKKNALFYKLDIVQLDGNSSQYRLINCNTSVITQACPKVSF
DPIPIHYCAPAGYAILKCNNKTFNGTGPCNNVSTVQCTHGIKPVVSTQLL
LNGSLAEGEIIIRSENITDNGKTIIVHLNESVKIECTRPSNNTRTSIRIG
PGQAFYATGQVIGDIREAHCNISESKWNETLQRVSKKLKEYFPHKNITFQ
PSSGGDLEITTHSFNCGGEFFYCNTSSLFNRTYMANSTETNSTRTITIRC
RIKQIINMWQEVGRAMYAPPIAGNITCISNITGLLLTRDGGENNTETFET
FRPGGGNMKDNWRSELYKYKVVEVKPLGVAPTNARRRAVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL Fig. 17 (cont.)
QTLIPSPRGPDRPGGIEEEGGEQDRNRSTRLVSGFLALAWDDLRSLCLFI
YHRLRDFILIAARAGELLGRSSLKGLRRGWEALKYLGSLVQYWGLELKRS
AISLLDTLAIAVGEGTDRILKFVLGICRAIRNIPTRIRQGFETALLZ
>w053.25
MRVMGIQRNYPQWWIWSMLGLWMLMICNGMWVTVYYGVPVWKEAKTTLFC
ASDAKAYEKEVHNVWATHACVPTDPNPQEMVLKNVTENFNMWENDMVDQM
HEDVISLWDQSLKPCVKLTPLCVTLNCTDATASNATASNATASNSSIIEG
MKNCSFNITTELRDKREKKNALFYKLDIVQLDGNSSQYRLINCNTSVITQ
ACPKVSFDPIPIHYCAPAGYAILKCNNKTFNGTGPCNNVSTVQCTHGIKP
VVSTQLLLNGSLAEGEIIIRSENITDNGKTIIVHLNESVKIECTRPSNNT
RTSIRIGPGQAFYATGQVIGDIREAHCNISENKWNETLQRVSKKLKEYFP
HKNITFQPSSGGDLEITTHSFNCGGEFFYCNTSSLFNRTYMANSTDMANS
TETNSTRTITIRCRIKQIINMWQEVGRAMYAPPIAGNITCISNITGLLLT
RDGGKNNTETFETFRPGGGNMKDNWRSELYKYKVVEVKPLGVAPTNARRR
VVEREKRAVGMGAVFLGFLGAAGSTMGAASITLTVQARQLLSGIVQQQSN
LLKAIEAQQHMLKLTVWGIKQLQARVLALERYLKDQQLLGMWGCSGKLIC
TTNVYWNSSWSNKTYGDIWDNMTWMQWEREISNYTEIIYELLEESQNQQE
KNEQDLLALDRWNSLWNWFNITNWLWYIKIFIMIVGGLIGLRIIFAVLSL
VNRVRQGYSPLSLQTLIPSPRGPDRPGGIEEEGGEQDRKRSTRLVSGFLA
LVWDDLRSLCLFIYHRLRDFILIAARAGELLGRSSLKGLRRGWEALKYLG
SLVQYWGLELKRSAISLLDTLAIAVGEGTDRILEFALGICRAIRNIPTRI
RQGFETALLZ
>w053.31
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTDATASNATASNATASNSSIIEG
MKNCSFNITTELRDKREKKNALFYKLDIVQLDGNSSQYRLINCNTSVITQ
ACPKVSFDPIPIHYCAPAGYAILKCNNKTFNGTGPCNNVSTVQCTHGIKP
VVSTQLLLNGSLAEGEIIIRSENITDNGKTIIVHLNESVKIECTRPSNNT
RTSIRIGPGQAFYATGQVIGDIREAHCNISESKWNETLQRVSKKLKEYFP
HKNITFQPSSGGDLEITTHSFNCGGEFFYCNTSSLFNRTYMANSTETNST
RIITIRCRIKQIINMWQEVGRAMYAPPIAGNITCISNITGLLLTRDGGNN
NTETFRPGGGNMKDNWRSELYKYKVVEVKPLGVAPTNARRRVVEREKRAV
GMGAVFLGFLGAAGSTMGAASITLTVQARQLLSGIVQQQSNLLKAIGAQQ
HMLKLTVWGIKQLQARVLALERYLKDQQLLGMWGCSGKLICTTNVYWNSS
WSNKTYGDIWDNMTWMQWEREISNYTEMIYELLEESQNQQEKNEQDLLAL
DRWNSLWNWFNITNWLWYIKIFIMIVGGLIGLRIIFAVLSLVNRVRQGYS
PLSLQTLIPSPRGPDRPGGIEEEGGEQDRKRSTRLVSGFLALVWDDLRSL
CLFIYHRLRDFILIAARAGELLGRSSLKGLRRGWEALKYLGSLVQYWGLE
LKRSAISLLDTLAIAVGEGTDRILEFALGICRAIRNIPTRIRQGFETALL
Z
>w053.16
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNANATASNSSIIEGMNSSIIEG
MKNCSFNITTELRDKREKKNALFYKLDIVQLDGNSSQYRLINCNTSVITQ
ACPKVSFDPIPIHYCAPAGYAILKCNNKTFNGTGPCNNVSTVQCTHGIKP
VVSTQLLLNGSLAEGEIIIRSENITDNGKTIIVHLNESVKIECTRPSNNT
RTSIRIGPGQAFYATGQVIGDIREAHCNISENKWNETLQRVSEKLKEYFP
HKNITFQPSSGGDLEITTHSFNCGGEFFYCNTSSLFNRTYMATSTDMANS
TETNSTRIITIRCRIKQIINMWQEVGRAMYAPPIAGNITCISNITGLLLT
RDGGKNNTETFETFRPGGGNMKDNWRSELYKYKVVEVKPLGVAPTNARRR
VVEREKRAVGMGAVFLGFLGAAGSTMGAASITLTVQARQLLSGIVQQQSN
LLKAIEAQQHMLKLTVWGIKQLQARVLALERYLKDQQLLGMWGCSGKLIC
TTNVYWNSSWSNKTYGDIWDNMTWMQWEREISNYTEIIYELLEESQNQQE
KNEQDLLALDRWNSLWNWFNITNWLWYIKIFIMIVGGLIGLRIIFAVLSL
VNRVRQGYSPLSLQTLIPSPRGPDRPGGIEEEGGEQDRNRSTRLVSGFLA
LAWDDLRSLCLFIYHRLRDFILIAARAGELLGRSSLKGLRRGWEALKYLG Fig. 17 (cont.)
SLVQYWGLELKRSAISLLDTLAIAVGEGTDRILEFVLGICRAIRNIPTRI
RQGFETALLZ
>w053.13
MRVMGRQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTDATASNATASNSSIIEGMNSSI
IEGMKNCSFNITTELRDKREKKNALFYKLDIVQLDGNSSQYRLINCNTSV
ITQACPKVSFDPIPIHYCAPAGYAILKCNNKTFNGTGPCNNVSTVQCTHG
IKPVVSTQLLLNGSLAEGEIIIRSENITDNGKTIIVHLNESVKIECTRPS
NNTRTSIRIGPGQAFYATGQVIGDIREAHCNISESKWNETLQRVSEKLKE
YFPHKNITFQPSSGGDLEITTHSFNCGGEFFYCNTSSLFNRTYMATSTDM
ANSTETNSTRIITIRCRIKQIINMWQEVGRAMYAPPIAGNITCISNITGL
LLTRDGGKNNTETFETFRPGGGNMKDNWRSELYKYKVVEVKPLGVAPTNA
RRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGK
LICTTNVYWNSSWSNKTYGDIWDNMTWMQWEREISDYTEIIYELLEESQN
QQEKNEQDLLALDRWNSLWNWFNITNWLWYIKIFIMIVGGLIGLRIIFAV
LSLVNRVRQGYSPLSLQTLIPSPRGPDRPGGIEEEGGEQDRNRSTRLVSG
FLALAWDDLRSLCLFIYHRLRDFILIAARAGELLGRSSLKGLRRGWEALK
YLGSLVQYWGLELKRSAISLLDTLAIAVGEGTDRILEFVLGICRAIRNIP
TRIRQGFETALLZ
>w078.6
MRVMGIQRNYPQWWIWSMLGLWMLMICNGMWVTVYYGVPVWKEAKTTLFC
ASDAKAYEKEVHNVWATHACVPTDPNPQEMVLKNVTENFNMWKNDMADQM
HEDVISLWDQSLKPCVKLTPLCVTLNCTDATASNATASNSSINSS
IIEEMKNCSFNITTELRDKREKKNALFYKLDIVQLDGNSSQYRLINCNTS
AITQACPKVSFDPIPIHYCAPAGYAILKCNNKTFNGTGPCNNVSTVQCTH
GIKPVVSTQLLLNGSLAEGEIIIRSENITDNGKTIIVHLNESVKIECTRP
SNNTRTSIRIGPGQAFYATGQVIGDIREAHCNISESKWNETLQRVSKKLK
EYFPHKNITFQPSSGGDLEVTTHSFNCGGEFFYCNTSSLFNRTDMANSTE
TNSTRIITIRCRIKQIVNMWQEVGRAMYAPPIAGNITCISNITGLLLTRD
GGENNGGKNNTETFRPGGGNMKDNWRSELYKYKVVEVKPLGVAPTNARRR
VVEREKRAVGMGAVFLGFLGAAGSTMGAASITLTVQARQLLSGIVQQQSN
LLKAIEAQQHMLKLTVWGIKQLQARVLALERYLKDQQLLGMWGCSGKLIC
TTNVYWNSSWSNKTYGDIWDNMTWMQWEREISNYTEIIYELLEESQNQQE
KNEQDLLALDRWNSLWNWFNITKWLWYIKIFIMIVGGLIGLRIIFAVLSL
VNRVRQGYSPLSLQTLIPSPRGPDRPGGIEEEGGEQDRNRSTRLVSGFLA
LAWDDLRSLCLFIYHRLRDFILIAARAGELLGRSSLKGLRRGWEALKYLG
GLVQYWGLELKRSAISLLDTLAIAVGEGTDRILEFVLGICRAIRNIPTRI
RQGFETALLZ
>w078.25
MRVMGRQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLTPCVKLTPLCVTLNCTDATASNATASNATASNS
SIIIEGMKNCSFNITTELRDKREKKNALFYKLDIVQLDGNSSQYRLINCN
TSVITQACPKVSFDPIPIHYCAPAGYAILKCNNKTFNGTGPCNNVSTVQC
THGIKPVVSTQLLLNGSLAEGEIIIRSKNITDNGKTIIVHLNESVKIECT
RPSNNTRTSIRIGPGQAFYATGQVIGDIREAHCNISESKWNETLQRVSEK
LKEYFPNKNITFQPSSGGDLEITTHSFNCGGEFFYCNTSSLFNRTYMANS
TDMANSTETNSTRIITIRCRIKQIINMWQEVGRAMYAPPIAGNITCISNI
TGLLLTRDGGKNNTETFETFRPGGGNMKDNWRSELYKYKVVEVKPLGVAP
TNARRRVVEREKRAVGMGAVFLGFLGAAGSTMGAASITLTVQARQLLSGI
VQQQSNLLKAIEAQQHMLKLTVWGIKQLQARVLALERYLKDQQLLGMWGC
SGKLICTTNVYWNSSWSNKTYGDIWDNMTWMQWEREISNYTEMIYELLEE
SQNQQEKNEQDLLALDRWNSLWNWFNITKWLWYIKIFIMIVGGLIGLRII
FAVLSLVNRVRQGYSPLSLQTLIPSPRGPDRPGGIEEEGGEQDRKRSTRL
VSGFLALAWDDLRSLCLFIYHRLRDFILIAARAGELLGRSSLKGLRRGWE
ALKYLGSLVQYWGRELKRSAISLLDTLAIAVGEGTDRILEFALRICRAIR

Fig. 17 (cont.)
```
NMPTRIRQGFETALLZ
>w078.9
MRVMGIQRNYPQWWIWSMLGLWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTDATASNATASNATASNATASNS
SIIIEGMKNCSFNITTELRDKREKKNALFYKLDIVQLDGNSSQYRLINCN
TSVITQACPKVSFDPIPIHYCAPAGYAILKCNNKTFNGTGPCNNVSTVQC
THGIKPVVSTQLLLNGSLAEGEIIIRSKNITDNGKTIIVHLNESVKIECT
RPSNNTRTSIRIGPGQAFYATGQVIGDIREAHCNISESKWNETLQRVSKK
LKEYFPQKNITFQPSSGGDLEITTHSFNCGGEFFYCNTSSLFNRTYMANS
TDMANSTETNRTITIRCRIKQIINMWQEVGRAMYAPPIAGNITCISNITG
LLLTRDGGKNNTETFETFRPGGGNMKDNWRSELYKYKVVEVKPLGVAPTN
ARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSG
KLICTTNVYWNSSWSNKTYGDIWDNMTWMQWEREISNYTEMIYELLEESQ
NQQEKNEQDLLALDRWNSLWNWFNITKWLWYIKIFIMIVGGLICLRIIFA
VLSLVNRVRQGYSPLSLQTLIPSPRGPDRPGGIEEEGGEQDRKRSTRLVS
GFLALVWDDLRSLCLFIYHRLRDFILIAARAGELLGRSSLKGLRRGWEAL
KYLGSLVQYWGLELKRSAISLLDTLAIAVGEGTDRILEFALGICRAIRNI
PTRIRQGFETALLZ
>w078.33
MRVTGIQRNYPQWWIWSMLGLWMLMICNGMWVTVYYGVPVWKEAKTTLFC
ASDAKAYEKEVHNVWATHACVPTDPNPQEMVLKNVTENFNMWKNDMADQM
HEDVISLWDQSLKPCVKLTPLCVTLNCIDANATASNATASNSSIIEGMKN
CSFNITTELRDKIEKKNALFYKLDIVQLDGNSSQYRLINCNTSVITQACP
KVSFDPIPIHYCAPAGYAILKCNNKTFNGTGPCNNVSTVQCTHGIKPVVS
TQLLLNGSLAEGEIIIRSENITNSAKTIIVHLNESVKIECTRPSNNTRTS
IRIGPGQAFYATGQVIGDIRKAHCNISESKWNETLQRVSKKLKEYFPHKN
ITFQPSSGGDLEITTHSFNCGGEFFYCNTSSLFNRTYMANSTETNSTRTI
TLHCRIKQIINMWQEVGRAMYAPPIAGNITCISNITGLLLTRDGGNNNTT
ETFRPGGGNMKDNWRSELYKYKVVEIKPLGVAPTNARRRVVEREKRAVGM
GAVFLGFLGAAGSTMGAASITLTVQARQLLSGIVQQQSNLLKAIEAQQHM
LKLTVWGIKQLQARVLALERYLKDQQLLGMWGCSGKLICTTNVYWNSSWS
NKTYGDIWDNMTWMQWEREISDYTEIIYELLEESQNQQEKNEQDLLALDR
WNSLWNWFNITNWLWYIKIFIMIVGGLIGLRIIFAVLSLVNRVRQGYSPL
SLQTLTPSPRGPDRPGGIEEEGGEQDRNRSTRLVSGFLALAWDDLRSLCL
FIYHRLRDFILIAARAGELLGRSSLKGLRRGWEALKYLGGLVQYWGLELK
RSAISLLDTLAIAVGEGTDRILEFVLGICRAIRNIPTRIRQGFETALLZ
>w078.17
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLDCINATNATASNSSILEGMKNCSFN
ITTELRDKREKKNALFYKLDIVQLGGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNGKTIIVHLNESVKIECTRPSNNTRTSIRIG
PGQAFYATGQVIGDIREAHCNISESKWNETLQRVSKKLKEYFPDKNITFQ
PSSGGDLEITTHSFNCGGEFFYCNTSSLFNRTYMVNSTDMANSTETNSTR
TITIRCRIKQIINMWQEVGRAMYAPPIAGNITCISNITGLLLTRDGGENN
TETFETFRPGGGNMKDNWRSELYKYKVVEVKPLGVAPTNARRRVVEREKR
AVGMGAVFLGFLGAAGSTMGAASITLTVQARQLLSGIVQQQSNLLKAIEA
QQHMLKLTVWGIKQLQARVLALERYLKDQQLLGMWGCSGKLICTTNVYWN
SSWSNKTYGDIWDNMTWMQWEREISNYTELIYELLEESQNQQEKNEQDLL
ALDRWNSLWNWFNITNWLWYIKIFIMIVGGLIGLRIIFAVLSLVNRVRQG
YSPLSLQTLIPSPRGPDRPGGIEEEGGEQDRNRSTRLVSGFLALAWDDLR
SLCLFIYHRLRDFILIAARAGELLGRSSLKGLRRGWEALKYLGSLVQYWG
LELKRSAISLLDTLAIAVGEGTDRILEFVLGICRAIRNIPTRIRQGFETA
LLZ
>w078.1
```

Fig. 17 (cont.)
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVRLTPLCVTLNCINATNATASNNSILEGMKNCSFN
IATELRDKREKKNALFYKLDIVQLDGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNGKTIIVHLNESVKIECTRPSNNTRTSIRIG
PGQAFYATGQVIGNIREAHCNISESKWNETLQRVSKKLKEYFPDKNITFQ
PSSGGDLEITTHSFSCGGEFFYCNTSSLFNRTYMATNTDMANSTETNSTR
IITIRCRIRQIINMWQEVGRAMYAPPIAGNITCISNITGLLLTRDGGENN
TETFETFRPGGGNMKDNWRSELYKYKVVEVKPLGVAPTNARRRVVEREKR
AVGMGAVFLGFLGAAGSTMGAASITLTVQARQLLSGIVQQQSNLLKAIEA
QQHMLKLTVWGIKQLQARVLALERYLKDQQLLGMWGCSGKLICTTNVYWN
SSWSNKTYGDIWDNMTWMQWEREISNYTELIYELLEESQNQQEKNEQDLL
ALDRWNSLWNWFNITNWLWYIKIFIMIVRGGLIGLRIIFAVLSLVNRRQG
YSPLSLQTLIPSPRGPDRPGGIEEEGGEQDRNRSTRLVSGFLALAWDDLR
SLCLFIYHRLRDFILIAARAGELLGRSSLKGLRRGWEALKYLGSLVQYWG
LELKRSAISLLDTLAIAVGEGTDRILEFVLGICRAIRNIPTRIRQGFETA
LLZ
>w078.15
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLSCTNATNATASNSSILEGMKNCSFN
ITTELRDKREKKNALFYKLDIVQLDGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNGKTIIVHLNESVKIECTRPSNNTRTSIRIG
PGQAFYATGQVIGDIREAHCNISESKWNETLQRVSEKLKEYFPHKNITFQ
PSSGGDLEITTHSFNCGGEFFYCNTSSLFNRTYMATSTDMANSTETNSTR
IITIRCRIKQIINMWQEVGRAMYAPPIAGNITCISNITGLLLTRDGGKND
TDTFRPEGGNMKDNWRSELYKYKVVEVKPLGVAPTNARRRVVEREKRAVG
MGAVFLGFLGAAGSTMGAASITLTVQARQLLSGIVQQQSNLLKAIEAQQH
MLKLTVWGIKQLQARVLALERYLKDQQLLGMWGCSGKLICTTNVYWNSSW
SNKTYGDIWDNMTWMQWEREISNYTELIYELLEESQNQQEKNEQDLLALD
RWNSLWNWFNITNWLWYIKIFIMIVGGLIGLRIIFAVLSLVNRVRQGYSP
LSLQTLIPSPRGPDRPGGIEEEGGEQDRNRSTRLVSGFLALAWDDLRSLC
LFIYHRLRDFILIAARAGELLGRSSLKGLRRGWEALKYLGNLVQYWGLEL
KRSAISLLDTLAIAVGEGTDRILEFVLGICRAIRNIPTRIRQGFETALLZ
>w078.10
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCIDATASNATAINISIIEEMKNCS
FNITTELRDKREKKNALFYKLDIVQLDGNSSQHRLINCNTSVITQACPKV
SFDPIPIHYCAPAGYAILKCNNKTFNGTGPCNNVSTVQCTHGIKPVVSTQ
LLLNGSLAEGEIIIRSKNITDNGKTIIVHLNESVKIECTRPSNNTRTSIR
IGPGQAFYATGQVIGNIREAHCNISESKWNETLQRVSEKLKEYFPHKNIT
FQPSSGGDLEITTHSFNCGGEFFYCNTSSLFNRTYMATSTDMANSTETNS
TRIITIRCRIKQIINMWQEVGRAMYAPPIAGNITCISNITGLLLTRDGGK
NDTDTETFRPEGGNMKDNWRSELYKYKVVEVKPLGVAPTNARRRVVEREK
RAVGMGAVFLGFLGAAGSTMGAASITLTVQARQLLSGIVQQQSNLLKAIE
AQQHMLKLTVWGIKQLQARVLALERYLKDQQLLGMWGCSGKLICTTNVYW
NSSWSNKTYGDIWDNMTWMQWEREISNYTDIIYELLEESQNQQEKNEQDL
LALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDL
RSLCLFIYHRLRDFILIAARAGELLGRSSLKGLRRGWEALKYLGSLVQYW
GLELKRSAISLLDTLAIAVGEGTDRILEFVLGICRAIRNIPTRIRQGFET
ALLZ
>w078.38
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM Fig. 17 (cont.)
HEDVISLWDQSLKPCVKLTPLCVTLNCIDATASNATAINISIIEEMKNCS
FNITTELRDKREKKNALFYKLDIVQLDGNSSQHRLINCNTSVITQACPKV
SFDPIPIHYCAPAGYAILKCNNKTFNGTGPCNNVSTVQCTHGIKPVVSTQ
LLLNGSLAEGEIIIRSKNITDNGKTIIVHLNESVKIECTRPSNNTRTSIR
IGPGQAFYATGQVIGNIREAHCNISKSKWNETLQRVSEKLKEYFPHKNIT
FQPSSGGDLEITTHSFNCGGEFFYCNTSSLFNRTYMATSTDMANSTETNS
TRIITIRCRIKQIINMWQEVGRAMYAPPIAGNITCISNITGLLLTRDGGK
NDTDTETFRPEGGNMKDNWRSELYKYKVVEVKPLGVAPTNARRRVVEREK
RAVGMGAVFLGFLGAAGSTMGAASITLTVQARQLLSGIVQQQSNLLKAIE
AQQHMLKLTVWGIKQLQARVLALERYLKDQQLLGMWGCSGKLICTTNVYW
NSSWSNKTYGDIWDNMTWMQWEREISNYTDIIYELLEESQNQQEKNEQDL
LALDRWNSLWNWFNITNWLWYIKIFIMIVGGLIGLRIIFAVLSLVNRVRQ
GYSPLSLQTLIPSPRGPDRPGGIEKEGGEQDRNRSTRLVSGFLALVWDDL
RSLCLFIYHRLRDFILIAARAGELLGRSSLKGLRRGWEALKYLGSLVQYW
GLELKRSAISLLDTLAIAVGEGTDRILEFVLGICRAIRNIPTRIRQGFET
ALLZ
>w078.7
MRVMGIQRNYTQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNVNATASNSSIIEGMNSSILEG
MKNCSFNITTELRDKREKKNALFYKLDIVQLGGNSSQYRLINCNTSVITQ
ACPKVSFDPIPIHYCAPAGYAILKCNNKTFNGTGPCNNVSTVQCTHGIKP
VVSTQLLLNGSLAEGEIIIRSKNITDNGKTIIVHLNESVKIECTRPSNNT
RTSIRIGPGQAFYATGQVIGDIREAHCNISESKWNETLQRVSEKLKEYFP
DKNITFQPSSGGDLEITTHSFNCGGEFFYCNTSSLFNRTYMANSTDMANS
TETNSTRIITIRCRIKQIINMWQEVGRAMYAPPIAGNITCISNITGLLLT
RDGGENNTETFETFRPGGGNMKDNWRSELYKYKVVEVKPLGVAPTNARRR
VVEREKRAVGMGAVFLGFLGAAGSTMGAASITLTVQARQLLSGIVQQQSN
LLKAIEAQQHMLKLTVWGIKQLQARVLALERYLKDQQLLGMWGCSGKLIC
TTNVYWNSSWSNKTYGDIWDNMTWMQWEREISNYTELIYELLEESQNQQE
KNEQDLLALDRWNSLWDWFNITNWLWYIKIFIMIVGGLIGLRIIFAVLSL
VNRVRQGYSPLSLQTLIPSPRGPDRPGGIEEEGGEQDRNRSTRLVSGFLA
LAWDDLRSLCLFIYHRLRDFILIAARAGELLGRSSLKGLRRGWEALKYLG
SLVQYWGLELKRSAISLLDTLAIAVGEGTDRILEFVLGICRAIRNIPTRI
RQGFETALLZ
>w100.A6
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCINATNATASNSSILEGMKNCSFN
ITTELRDKREKKNALFYKLDIVQLDGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNGKTIIVHLNESVKIECTRPSNNTRTSIRIG
PGQAFYATGQVIGNIREAHCNISESKWNETLQRVSEKLKEYFPQKNITFQ
PSSGGDLEITTHSFNCGGEFFYCNTSSLFNRTYMATSTDMANSTETNSTR
IITIRCRIKQIINMWQEVGRAMYAPPIAGNITCISNITGLLLTRDGGNDT
DTETFRPEGGNMKDNWRSELYKYKVVEVKPLGVAPTNARRRVVEREKRAV
GMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSS
WSNKTYGDIWDNMTWMQWEREISNYTDIIYELLEESQNQQEKNEQDLLAL
DRWNSLWNWFNITNWLWYIKIFIMIVGGLIGLRIIFAVLSLVNRVRQGYS
PLSLQTLIPSPRGPDRPGGIEEEGGEQDRNRSTRLVSGFLALAWDDLRSL
CLFIYHRLRDFILIAARAGELLGRSSLKGLRRGWEALKYLGSLVQYWGLE
LKRSAISLLDTLAIAVGEGTDRILEFVLGICRAIRNIPTRIRQGFETALL
Z
>w100.A12
MRVRGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVRLTPLCVTLNCINATNATASNSSILEGMKNCSFN Fig. 17 (cont.)
ITTELRDKREKKNALFYKLDIVQLDGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNGKTIIVHLNESVKIECTRPSNNTRTSIRIG
PGQAFYATGQVIGDIREAHCNISESKWNETLQRVSEKLKEYFPDKNITFQ
PSSGGDLEITTHSFNCGGEFFYCNTSSLFNRTYMANSTDMANSTETNSTR
IITLHCRIKQIINMWQEVGRAMYAPPIAGNITCISNITGLLLTRDGGNDT
DTETFRPEGGNMKDNWRSELYKYKVVEVKPLGVAPTNARRRVVEREKRAV
GMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSS
WSNKTYGDIWDNMTWMQWEREISNYTDIIYELLEESQNQQEKNEQDLLAL
DRWNSLWNWFNITNWLWYIKIFIMIVGGLIGLRIIFAVLSLVNRVRQGYS
PLSLQTLIPSPRGPDRPGGIEEGGGEQDRNRSTRLVSGFLALAWDDLRSL
CLFIYHRLRDFILIAARAGELLGRSSLKGLRRGWEALKYLGSLVQYWGLE
LKRSAISLLDTLAIAVGEGTDRILEFVLGICRAIRNIPTRIRQGFETALL
Z
>w100.A4
MRVMGIQRSYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVRLTPLCVTLNCINATNATASNSSILEGMKNCSFN
ITTELRDKREKKNALFYKLDIVQLDGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNGKTIIVHLNESVKIECTRPSNNTRTSIRIG
PGQAFYATGQVIGDIREAHCNISESKWNETLQRVSEKLKEYFPDKNITFQ
PSSGGDLEITTHSFNCGGEFFYCNTSNLFNRTYMVNSTDMANSTETNSTR
TITISCRIKQIINMWQEVGRAMYAPPIAGNITCISNITGLLLTRDGGKND
TDTETFRPEGGNMKDNWRSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYGDIWDNMTWMQWEREISNYTDIIYELLEESQNQQEKNEQDLLA
LDRWNSLWNWFNITNWLWYIKIFIMIVGGLIGLRIIFAVLSLVNRVRQGY
SPLSLQTLIPSPRGPDRPGGIEEEGGEQDRNRSTRLVSGFLALAWDDLRS
LCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETAL
LZ
>w100.A10
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTDATNATASNSSILGGMKNCSFN
ITTELRDKREKKNALFYKLDIVQLDGNSSQYRLINCNTSAITQACPKVSF
DPIPIHYCAPAGYAILKCNNKTFNGTGPCNNVSTVQCTHGIKPVVSTQLL
LNGSLAEGEIIIRSKNITDNGKTIIVHLNESVKIECTRPSNNTRTSIRIG
PGQAFYATGQVIGDIREAHCNISESKWNETLQRVSEKLKEYFPDKNITFQ
PSSGGDLEITTHSFNCGGEFFYCNTSSLFNRTYMANSTDMANSTETNSTR
IITIRCRIKQIINMWQEVGRAMYAPPIAGNITCISNITGLLLTRDGGKND
TDTETFRPEGGNMKDNWRSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYGDIWDNMTWMQWEREISNYTELIYELLEESQNQQEKNEQDLLA
LDRWNSLWNWFNITNWLWYIKIFIMIVGGLIGLRIIFAVLSLVNRVRQGY
SPLSLQTLIPSPRGPDRPGGIEEEGGEQDRNRSTRLVSGFLALAWDDLRS
LCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETAL
LZ
>w100.A3
MRVMGIQKNCPQWWIWSMLGLWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTDANATASNSSIIKGMNSSMIEE
MKNCSFNITTELRDKREKKNALFYKLDIVQLDGNSSQYRLINCNTSVITQ

Fig. 17 (cont.)
ACPKVSFDPIPIHYCAPAGYAILKCNNKTFNGTGPCNNVSTVQCTHGIKP
VVSTQLLLNGSLAEGEIIIRSKNITDNGKTIIVHLNESVKIECTRPSNNT
RTSIRIGPGQAFYATGQVIGDIREAHCNISESKWNETLQRVSKKLKEYFP
QKDITFQPSSGGDLEITTHSFNCGGEFFYCNTSSLFNRTYMATSTDMANS
TETNSTRIITIRCRIKQIINMWQEVGRAMYAPPIAGNITCISNITGLLLT
RDGGENDTDTETFRPEGGNMKDNWRSELYKYKVVEVKPLGVAPTNARRRV
VEREKRAVGMGAVFLGFLGAAGSTMGAASITLTVQARQLLSGIVQQQSNL
LKAIEAQQHMLKLTVWGIKQLQARVLALERYLKDQQLLGMWGCSGKLICT
TNVYWNSSWSNKTYGDIWDNMTWMQWEREISNYTDIIYELLEESQNQQEK
NEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLAL
AWDDLRSLCLFIYHRLKDFILIAARAGELLGRSSLKGLRRGWEALKYLGS
LVQYWGLELKRSAISLLDTLAIAVGEGTDRILEFVLGICRAIRNIPTRIR
QGFETALLZ
>w100.B2
MRVMGIQRNYPQWWIWSMLGLWMLMICNGMWVTVYYGVPVWKKAKTTLFC
ASDAKAYEKEVHSVWATHACVPTDPNPQEMVLKNVTENFNMWKNDMVDQM
HEDVISLWDQSLKPCVKLTPLCVTLNCTDANATASNSSIIKGMNSSMIEE
MKNCSFNITTELRDKREKKNALFYKLDIVQLDGNSSQYRLINCNTSVITQ
ACPKVSFDPIPIHYCAPAGYAILKCNNKTFNGTGPCNNVSTVQCTHGIKP
VVSTQLLLNGSLAEGEIIIRSENITNSAKTIIVHLNESVKIECTRPSNNT
RTSIRIGPGQAFYATGQVIGDIRKAHCNISESKWNETLQRVSKKLKEYFP
DRNITFQPSSGGDPEITTHSFNCGGKFFYCNTSSLFNRTYMANSTDMANS
TETNSTRIITIRCRIKQIINMWQEVGRAMYAPPIAGNITCISNITGLLLT
RDGGNNNTETFRPVGGNMKDNWRSKLYKYKVVEVKPLGVAPTKARRRMVE
REKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTN
VYWNSSWSNKTYGDIWDNMTWMQWEREISNYTEIIYDLLEESQNQQEKNE
QDLLALDRWNSLWNWFNITKWLWYIKIFIMIVGGLIGLKIIFAVLSLVNR
VRQGYSPLSLQTLIPSPRGPDRPGGIEEEGGEQDRNRSTRLVSGFLALAW
DDLRSLCLFIYHRLRDFILIAARAGELLGRSSLKGLRRGWEALKYLEGLV
QYWGLELKRSAISLLDTLAIAVGEGTDRILEFVLGICRAIRNIPTRIRQG
FETALLZ
>w100.B4
MRVMGRQRNYPQWWIWSMLGLWMLMICNGMWVTVYYGVPVWKEAKTTLFC
ASDAKAYEKEVHNVWATHACVPTDPNPQEMVLKNVTENFNMWENDMVDQM
HEDVISLWDQSLKPCVKLTPLCVTLNCTDANATASNTNATASNINATASK
NSIIEEMKNCSFNITTELRDKREKKYALFYKLDIVQLDGNSSQYRLINCN
TSVITQACPKVSFDPIPIHYCAPAGYAILKCNNKTFNGTGPCNNVSTVQC
THGIKPVVSTQLLLNGSLAEGEIIIRSKNITDNGKTIIVHLNESVKIECT
RPSNNTRTSIRIGPGQAFYATGQVIGDIREAHCNISESKWNETLQRVSKK
LKEYFPDKNITFQSSSGGDPEITTHSFNCGGEFFYCNTSSLFNRTYMANS
TDMANSTETNSTRIITIRCRIKQIINMWQEVGRAMYAPPIAGNITCISNI
TGLLLTRDGGNSSTETFRPEGGNMKDNWRSELYKYKVVEVKPLGVAPTNA
RRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGK
LICTTNVYWNSSWSNKTYDDIWDNMTWMQWEREISNYTEMIYDLLEESQN
QQEKNEQDLLALDRWNSLWNWFNITKWLWYIKIFIMIVGGLIGLRIIFAV
LSLVNRVRQGYSPLSLQTLIPSPRGPDRPGGIEEEGGEQDRKRSTRLVSG
FLALVWDDLRSLCLFIYHRLRDFILIAARAGELLGRSSLKGLRRGWEALK
YLGSLVQYWGLELKRSAISLLDTLAIAVGEGTDRILEFVLGICRAIRNIP
TRIRQGFETALLZ
>w100.C7
MRVMGIQRNYPQWWIWSMLGLWMLMTCNGMWVTVYYGVPVWKEAKTTLFC
ASDAKAYEKEVHNVWATHACVPTDPNPQEMVLKNVTENFNMWENDMVDQM
HEDVISLWDQSLKPCVKLTPLCVTLNCTDANATASNTNATASNINATASK
SSIIEEMKNCSFNITTELRDKREKKYALFYKLDIVQLDGNSSQYRLINCN
TSVITQACPKVSFDPIPIHYCAPAGYAILKCNNKTFNGTGPCNNVSTVQC Fig. 17 (cont.)
THGIKPVVSTQLLLNGSLAEGEIIIRSKNITDNGKTIIVHLNESVKIECT
RPSNNTRTSIRIGPGQAFYATGQVIGDIREAHCNISESKWNETLQRVSKK
LKEYFPDKNITFQSSSGGDPEITTHSFNCGGEFFYCNTSSLFNRTYMANS
TDMANSTETNSTRIITIHCRIKQIINMWQEVGRAMYAPPIAGNITCISNI
TGLLLTRDGGENNGGKNNTETFRPGGGNMKDNWRSELYKYKVVEVKPLGV
APTKARRRVVEREKRAVGMGAVFLGFLGAAGSTMGAASITLTVQARQLLS
GIVQQQSNLLKAIEAQQHMLKLTVWGIKQLQARVLALERYLKDQQLLGMW
GCSGKLICTTNVYWNSSWSNKTYGDIWDNMTWMQWEREISNYTDIIYDLL
EESQNQQEKNEQDLLALDRWNSLWNWFNITKWLWYIKIFIMIVGGLIGLR
IIFAVLSLVNRVRQGYSPLSLQTLIPSPRGPDRPGGIEEEGGEQDRNRST
RLVSGFLALAWDDLRSLCLFIYHRLRDFILIAARAGELLGRSSLKGLRRG
WEALKYLGGLVQYWGLELKRSAISLLDTLAIAVGEGTDRILEFVLGICRA
IRNIPTRIRQGFETALLZ
>w100.b7
TRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMADQM
HEDVISLWDQSLKPCVKLTPLCVTLNCTDANATASNINATASKSSIIEEM
KNCSFNITTELRDKREKKYALFYKLDIVQLDGNSSQYRLINCNTSVITQA
CPKVSFDPIPIHYCAPAGYAILKCNNKTFNGTGPCNNVSTVQCTHGIKPV
VSTQLLLNGSLAEGEIIIRSENITDNSKTIIVHLNESVKIECTRPSNNTR
TSIRIGPGQAFYATGQVIGDIREAHCNISESKWNETLQRVSKKLKEYFPD
KNITFQPSSGGDPEITTHSFNCGGEFFYCNTSSLFNRTYMANSTETNSTR
TITLHCRIKQIINMWQEVGRAMYAPPIAGNITCISNITGLLLTRDGGENT
RDGGNNNTETFRPEGGNMKDNWRSELYKYKVVEVKPLGVAPTKARRRVVE
REKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTN
VYWNSSWSNKTYGDIWDNMTWMQWEREISNYTDIIYELLEESQNQQEKNE
QDLLALDRWNSLWNWFNITNWLWYIKIFIMIVGGLIGLRIIFAVLSLVNR
VRQGYSPLSLQTLIPSPRGPDRPGGIEEEGGEQDRNRSTRLVSGFLALAW
DDLRSLCLFIYHRLRDFILIAARAGELLGRSSLKGLRRGWEALKYLGSLV
QYWGLELKRSAISLLDTLAIAVGEGTDRILEFVLGICRAIRNIPTRIRQG
FETALLZ
>w100.B6
MKVRGIQRNYPQWWIWSMLGLWMLMICNGMWVTVYYGVPVWKEAKTTLFC
ASDAKAYEKEVHNVWATHACVPTDPNPQEMVLENVTENFNMWKNDMADQM
HEDVISLWDQSLKPCVKLTPLCVTLNCTDANATASNTNATASNINATASK
SSIIEEMKNCSFNITTELRDKREKKYALFYKLDIVQLDGNSSQYRLINCN
TSVITQACPKVSFDPIPIHYCAPAGYAILKCNNKTFNGTGPCNNVSTVQC
THGIKPVVSTQLLLNGSLAEGEIIIRSENITDNSKTIIVHLNESVKIECT
RPSNNTRTSIRIGPGQAFYATGQVIGDIREAHCNISESKWNETLQRVSKK
LKEYFPDKNITFQPSSGGDPEITTHSFNCGGEFFYCNTSSLFNRTYMANS
TETNSTRTITLHCRIKQIINMWQEVGRAMYAPPIAGNITCISNITGLLLT
RDGGENTRDGGNNNTETFRPEGGNMKDNWRSELYKYKVVEVKPLGVAPTK
ARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSG
KLICTTNVYWNSSWSNKTYGDIWDNMTWMQWEREISNYTDIIYDLLEESQ
NQQEKNEQDLLALDRWNSLWNWFNITKWLWYIKIFIMIVGGLIGLRIIFA
VLSLVNRVRQGYSPLSLQTLIPSPRGPDRPGGIEEEGGEQDRNRSTRLVS
GFLALAWDDLRSLCLFIYHRLRDFILIAARAGELLGRSSLKGLRRGWEAL
KYLGGLVQYWGLELKRSAISLLDTLAIAVGEGTDRILEFVLGICRAIRNI
PTRIRQGFETALLZ
>w100.A13
MRVMGIQRNYPQWWIWSMLGLWMLMICNGMWVTVYYGVPVWKEAKTTLFC
ASDAKAYEKEAHNVWATHACVPTDPNPQEMVLKNVTENFNMWKNDMADQM
HEDVISLWDQSLKPCVKLTPLCVTLNCTDANATASNANATASNTNATVSN
SSIIEEMKNCSFNITTELRDKREKKYALFYKLDIVQLDGNSSQYRLINCN
TSVITQACPKVSFDPIPIHYCAPAGYAILKCNNKTFNGTGPCNNVSTVQC
THGIKPVVSTQLLLNGSLAEGEIIIRSENITNSAKTIIVHLNESVKIECT

Fig. 17 (cont.)
RPSNNTRTSIRIGPGQAFYATGQVIGDIRKAHCNISESKWNETLQRVSKK
LKEYFPHKNITFQPSSGGDPEITTHSFNCGGEFFYCNTSSLFNRTYMANS
TETNSTRTITLHCRIKQIINMWQEVGRAMYAPPIAGNITCISNITGLLLT
RDGGENTRDGGNNNTETFRPGGGNMKDNWRSELYKYKVVEVKPLGVAPTN
ARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSG
KLICTTNVYWNSSWSNKTYGDIWDNMTWMQWEREISNYTDIIYDLLEESQ
NQQEKNEQDLLALDRWNSLWNWFNITKWLWYIKIFIMIVGGLIGLRIIFA
VLSLVNRVRQGYSPLSLQTLIPSPRGPDRPGGIEEEGGEQDRNRSTRLVS
GFLALAWDDLRSLCLFIYHRLRDFILIAARAGELLGRSSLKGLRRGWEAL
KYLGGLVQYWGLELKRSAISLLDTLAIAVGEGTDRILEFVLGICRAIRNI
PTRIRQGFETALLZ
>w136.B10
MRVMGIQRSYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLSCINATNATDSNNSILEGMKNCSFN
ITTELRDKREKKNALFYKLDIVQLYGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNGKTIIVHLNESVKIECTRPSNNTRTSIRIG
PGQAFYATGQVIGNIREAHCNISESKWNETLQRVSEKLKEYFPDKNITFQ
PSSGGDLEITTHSFNCGGEFFYCNTSSLFNRTYMATSTDMANSTETNSTR
IITIHCRIKQIINMWQEVGRAMYAPPIAGNITCISNITGLLLTRDGGNNT
EDTETFRPEGGNMKDNWRSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYSDIWDNMTWMQWEREISNYTDMIYELLEESQNQQEKNEQDLLA
LDRWNSLWNWFNITNWLWYIKIFIMIVGGLIGLRIIFAVLSLVNRVRQGY
SPLSLQTLIPSPRGPDRPGGIEEEGGEQDRNRSTRLVSGFLALAWDDLRS
LCLFIYHRLRDFILIAARAGELLGRSSLKGLRRGWEALKYLGSLGQYWGL
ELKRSAISLLDTLAIAVGEGTDRILEFVLGICRAIRNIPTRIRQGFETAL
LZ
>w136.B27
MRVRGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCINATNATASNSNILEGMKNCSFN
ITTELRDKREKKNALFYKLDIVQLGGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNSKTIIVHLNESVKIECTRPSNNTRTSIRIG
PGQAFYATGQVIGNIREAHCNISESKWNETLQRVSEKLKEYFPDKNITFQ
PSSGGDLEITTHSFNCGGEFFYCNTSSLFNRTYMANSTDMANSTETNSTR
IITLHCRIKQIINMWQEVGRAMYAPPIAGNITCISNITGLLLTRDGGNNT
EDTETFRPEGGNMKDNWRSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYSDIWDNMTWMQWEREISNYTDMIYELLEESQNQQEKNEQDLLA
LDRWNSLWNWFNITNWLWYIKIFIMIVGGLIGLRIIFAVLSLVNRVRQGY
SPLSLQTLIPSPRGPDRPGGIEEEGGEQDRNRSTRLVSGFLALAWNDLRS
LCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETAL
LZ
>w136.B12
TRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCINATNATDSNSNILEGMKNCSFN
ITTELRDKREKKNALFYKLDIVQLGGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNSKTIIVHLNESVKIECTRPSNNTRTSIRIG
PGQAFYATGQVIGNIREAHCNISESKWTETLQRVSEKLKKYFPDKNITFR

Fig. 17 (cont.)
```
PSSGGDLEITTHSFNCGGEFFYCNTSSLFNRTYMATSTDMANSTEINSTR
IITIHCRIKQIINMWQEVGRAMYAPPIAGNITCISNITGLLLTRDGGNNT
EDTETFRPEGGNMKDNWRSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYDDIWDNMTWMQWEREISNYTNIIYELLEESQNQQEKNEQDLLA
LDRWNSLWNWFNITNWLWYIKIFIMIVGGLIGLRIIFAVLSLVNRVRQGY
SPLSLQTLIPSPRGPDRPGGIEEEGGEQDRNRSTRLVSGFLALAWDDLRS
LCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETAL
LZ
>w136.B4
MRVRGIQRSYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCINATNATDSNSNILEGMKNCSFN
ITTELRDKREKKNALFYKLDIVQLGGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNSKTIIVHLNESVKIECTRPSNNTRTSIRIG
PGQAFYATGQVIGNIREAHCNISESKWNETLQRVSEKLKKYFPDKNITFR
PSSGGDLEITTHSFNCGGEFFYCNTSSLFNRTYMATSTDMANSTETNSTR
IITIHCRIKQIINMWQEVGRAMYAPPIAGNITCISNITGLLLTRDGGNNT
EDTETFRPEGGNMKDNWRSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYDDIWDNMTWMQWEREISNYTNIIYELLEESQNQQEKNEQDLLA
LDRWNSLWNWFNITNWLWYIKIFIMIVGGLIGLRIIFAVLSLVNRVRQGY
SPLSLQTLIPSPRGPDRPGGIEEEGGEQDRNRSTRLVSGFLALAWDDLRS
LCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETAL
LZ
>w136.B29
MRVRGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCINATNATDSNSNILEGMKNCSFN
ITTELRDKREKKNALFYKLDIVQLGGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNSKTIIVHLNESVKIECTRPSNNTRTSIRIG
PGQAFYATGQVIGNIREAHCNISESKWNETLQRVSEKLKKYFPDKNITFR
PSSGGDLEITTHSFNCGGEFFYCNTSSLFNRTYMATSTDMANSTETNSTR
IITIHCRIKQIINMWQEVGRAMYAPPIAGNITCISNITGLLLTRDGGNNT
EDTETFRPEGGNMKDNWRSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYDDIWDNMTWMQWEREISNYTNIIYELLEESQNQQEKNEQDLLA
LDRWNSLWNWFNITNWLWYIKIFIMIVGGLIGLRIIFAVLSLVNRVRQGY
SPLSLQTLIPSPRGPDRPGGIEEEGGEQDRNRSTRLVSGFLALAWDDLRS
LCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETAL
LZ
>w136.B8
MRVRGIQRSYPQWWIWSMLGFWMLMICNGMWVTVYYGVPVWKEAKTTLFC
ASDAKAYEKEVHNVWATHACVPTDPNPQEMVLKNVTENFNMWENDMVDQM
HEDVISLWDQSLKPCVKLTPLCVTLNCINATNATDSNSNILEGMKNCSFN
ITTELRDKREKKNALFYKLDIVQLGGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNSKTIIVHLNESVKIECTRPSNNTRTSIRIG
PGQAFYATGQVIGNIREAHCNISESKWNETLQRVSEKLKKYFPDKNITFR
PSSGGDLEITTHSFNCGGEFFYCNTSSLFNRTYMATSTDMANSTETNSTR
```

Fig. 17 (cont.)

IITIHCRIKQIINMWQEVGRAMYAPPIAGNITCISNITGLLLTRDGGNNT
EDTETFRPEGGNMKDNWRSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYDDIWDNMTWMQWEREISNYTNIIYELLEESQNQQEKNEQDLLA
LDRWNSLWNWFNITNWLWYIKIFIMIVGGLIGLRIIFAVLSLVNRVRQGY
SPLSLQTLIPSPRGPDRPGGIEEEGGEQDRNRSTRLVSGFLALAWDDLRS
LCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETAL
LZ
>w136.B36
MRVRGIQRSYPQWWIWSMLGFWMLMICNGMWVTVYYGVPVWKEAKTTLFC
ASDAKAYEKEVHNVWATHACVPTDPNPQEMVLKNVTENFNMWENDMVDQM
HEDVISLWDQSLKPCVKLTPLCVTLNCINATNATDSNSNILEGMKNCSFN
ITTELRDKREKKNALFYKLDIVQLGGNSSQYRLINCNTSVITQACPKVSF
DPIPIHYCAPAGYAILKCNNKAFNGTGPCNNVSTVQCTHGIKPVVSTQLL
LNGSLAEGEIIIRSKNITDNSKTIIVHLNESVKIECTRPSNNTRTSIRIG
PGQAFYATGQVIGNIREAHCNISESKWNETLQRVSEKLKKYFPDKNITFR
PSSGGDLEITTHSFNCGGEFFYCNTSSLFNRTYMATSTDMANSTETNSTR
IITIHCRIKQIINMWQEVGRAMYAPPIAGNITCISNITGLLLTRDGGNNT
EDTETFRPEGGNMKDNWRSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYDDIWDNMTWMQWEREISNYTNIIYELLEESQNQQEKNEQDLLA
LDRWNSLWNWFNITNWLWYIKIFIMIVGGLIGLRIIFAVLSLVNRVRQGY
SPLSLQTLIPSPRGPDRPGGIEEEGGEQDRNRSTRLVSGFLALAWDDLRS
LCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETAL
LZ
>w136.B20
MRVRGIQRSYPQWWIWSMLGFWMLMICNGMWVTVYYGVPVWREAKTTLFC
ASDAKAYEKEVHNVWATHACVPTDPNPQEMVLKNVTENFNMWENDMVDQM
HEDVISLWDQSLKPCVKLTPLCVTLNCINATNATDSNSNILEGMKNCSFN
ITTELRDKREKKNALFYKLDIVQLGGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNSKTIIVHLNESVKIECTRPSNNTRTSIRIG
PGQAFYATGQVIGNIREAHCNISESKWNETLQRVSKKLKKYFPDKNITFR
PSSGGDLEITTHSFNCGGEFFYCNTSSLFNRTYMATSIDMANSTETNSTR
IITIHCRIKQIINMWQEVGRAMYAPPIAGNITCISNITGLLLTRDGGNNT
EDTETFRPEGGNMKDNWRSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYDDIWDNMTWMQWEREISNYTNIIYELLEESQNQQEKNEQDLLA
LDRWNSLWNWFNITNWLWYIKIFIMIVGGLIGLRIIFAVLSLVNKVRQGY
SPLSLQTLIPSPRGPDRPGGIEEEGGEQDRNRSTRLVSGFLALAWDDLRS
LCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETAL
LZ
>w136.B5
MRVMGTQRNYPQWWIWSMLGLWMLMICNGMWVTVYYGVPVWKEAKTTLFC
ASDAKAYEKEVHNVWATHACVPTDPNPQEMVLKNVTENFNMWKNDMADQM
HEDVISLWDQSLKPCVKLTPLCVTLYCINATANATVSNSSIIEEMKNCSF
NITTELRDKREKKNALFYKLDIVQLDGNSSQYRLINCNTSAITQACPKVS
FDPIPIHYCAPAGYAILKCNNKTFNGTGPCNNVSTVQCTHGIKPVVSTQL
LLNGSLAEGEIIIRSENITNSAKTIIVHLNESVKIECTRPSNNTRTSIRI
GPGQAFYATGQVIGDIRQAHCNISESKWNETLQRVSEKLKEYFPNKTITF
QPSSGGDPEITTHSFNCGGEFFYCNTSSLFNRTYMANSTDMANSTETNST
RTITLHCRIKQIINMWQEVGRAMYAPPIAGNITCISNITGLLLTRDGGNS

Fig. 17 (cont.)
SKETETFRPGGGNMKDNWRSELYKYKVVEVKPLGVAPTNARRRVVEREKR
AVGMGAVFLGFLGAAGSTMGAASITLTVQARQLLSGIVQQQSNLLKAIEA
QQHMLKLTVWGIKQLQARVLALERYLKDQQLLGMWGCSGKLICTTNVYWN
SSWSNKTYGDIWDNMTWMQWEREISNYTDLIYDLLEESQNQQEKNEQDLL
ALDRWNSLWNWFNITKWLWYIKIFIMIVGGLIGLRIIFAVLSLVNRVRQG
YSPLSLQTLIPSPRGPDRPGGIEEEGGEQDRNRSTRLVSGFLALAWDDLR
SLCLFLYHRLRDFILIAARAGELLGRSSLKGLRRGWEALKYLGGLVQYWG
LELKRSAISLLDTLAIAVGEGTDRILEFVLGICRAIRNIPTRIRQGFETA
LLZ
>w136.B2
MRVRGIQRNYPQWWIWSMLGLWMLMICNGMWVTVYYGVPVWKEAKTTLFC
ASDAKAYEKEAHNVWATHACVPTDPNPQEMVLKNVTENFNMWENDMVDQM
HEDVISLWDQSLKPCVKLTPLCVTLNCTDANATASNTNATVSNIKATVSN
SSIIEEMKNCSFNITTELRDKIEKKYALFYKLDIVQLDGNSTQYRFINCN
TSAITQACPKVSFDPIPIHYCAPAGYAILKCNNKTFNGTGPCNNVSTVQC
THGIKPVVSTQLLLNGSLAEGEIIIRSENITDNGKTIIVHLNESVKIECT
RPGNNTRTSIRIGPGQAFYATGQVIGDIRQAHCNISESKWNETLQRVSEK
LKEYFPNKTITFQPSSGGDPEITTHSFNCGGEFFYCNTSSLFNRTYMANS
TETNSTRTITLHCRIKQIINMWQEVGRAMYAPPIAGNITCISNITGLLLT
RDGGNTTDIETFRPGGGNMKDNWRSELYKYKVVEVKPLGVAPTKARRRVV
EREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTT
NVYWNSSWSNKTYDDIWDNMTWMQWEREISNYTEIIYDLLEESQNQQEKN
EQDLLALDRWNSLWNWFNITKWLWYIKIFIMIVGGLIGLRIIFAVLSLVN
RVRQGYSPLSLQTLIPSPRGPDRPGGIEEEGGEQDRNRSTRLVSGFLALA
WDDLRSLCLFIYHRLRDFILIAARAGELLGRSSLKGLRRGWEALKYLGGI
VQYWGLELKRSAISLLDTLAIAVGEGTDRILEFVLGICRAIRNIPTRIRQ
GFETALLZ
>w136.B3
MRVRGIQRNYPQWWIWSMLGLWMLMICNGMWVTVYYGVPVWKEAKTTLFC
ASDAKAYEKEAHNVWATHACVPTDPNPQEMVLKNVTENFNMWENDMVDQM
HEDVISLWDQSLKPCVKLTPLCVTLNCTDANATASNANATASNTNATVSN
DSSIIEEMKNCSFNITTELRDKIEKKYALFYKLDIVQLDGNSTQYRFINC
NTSAITQACPKVSFDPIPIHYCAPAGYAILKCNNKTFNGTGPCNNVSTVQ
CTHGIKPVVSTQLLLNGSLAEGEIIIRSKNITDNGNTIIVHLNESVKIEC
TRPSNNTRTSIRIGPGQAFYATGQVIGDIRQAHCNISESKWNETLQRVSE
KLKEYFPDKNITFQPSSGGDPEITTHSFNCGGEFFYCNTSSLFNRTYMAN
STETNSTRTITLHCRIKQIINMWQEVGRAMYAPPIAGNITCISNITGLLL
TRDGGNSSKETETFRPGGGNMKDNWRSELYKYKVVEVKPLGVAPTNARRR
VVEREKRAVGMGAVFLGFLGAAGSTMGAASITLTVQARQLLSGIVQQQSN
LLKAIEAQQHMLRLTVWGIKQLQARVLALERYLKDQQLLGMWGCSGKLIC
TTNVYWNSSWSNKTYSDIWDNMTWMQWEGEISNYTEIIYNLLEESQNQQE
KNEQDLLALDRWNSLWNWFNITKWLWYIKIFIMIVGGLIGLRIIFAVLSL
VNRVRQGYSPLSLQTLIPSPRGPDRPGGIEEEGGEQDRKRSTRLVSGFLA
LVWDDLRSLCLFLYHRLRDFILIAARAGELLGRSSLKGLRRGWEALKYLG
SLVQYWGLELKGSAISLLDTLAIAVGEGTDRILEFVLGICRAIRNIPTRI
RQGFETALLZ
>w136.B18
MRVMGRQRNYPQWWIWSMLGLWMLMICNGMWVTVYYGVPVWKEAKTTLFC
ASDAKAYEKEVHNVWATHACVPTDPNPQEMVLKNVTENFNMWKNDMVDQM
HEDVISLWDQSLTPCVKLTPLCVTLNCTDANDTASNSSIIKGMNNSIVGE
MKNCSFNITTELRDKREKKNALFYKLDIVQLDGNSSEYRLINCNTSVITQ
ACPKVSFDPIPIHYCAPAGYAILKCNNKTFNGTGPCNNVSTVQCTHGIKP
VVSTQLLLNGSLAEGEIIIRSENITDNAKTIIVHLNESVKIECTRPSNNT
RTSIRIGPGQAFYATGQVIGDIRKAHCNISESKWNETLQRVSKKLKEYFP
DKNITFQPSSGGDPEITTHSFNCGGEFFYCNTSSLFNRTYMANSTDMANS
AETNSTRTITLHCRIKQIINMWQEVGRAMYAPPIAGNITCISNITGLLLT
RDGGNSSTETETFRPGGGNMKDNWRSELYKYKVVEVKPLGVAPTNARRRV Fig. 17 (cont.)
VEREKRAVGMGAVFLGFLGAAGSTMGAASITLTVQARQLLSGIVQQQSNL
LKAIEAQQHMLRLTVWGIKQLQARVLALERYLKDQQLLGMWGCSGKLICT
TNVYWNSSWSNKTYDDIWDNMTWMQWEGEISNYTNIIYDLLEESQNQQEK
NEQDLLALDRWNSLWNWFNITNWLWYIKIFIMIVGGLIGLRIIFAVLSLV
NRVRQGYSPLSLQTLIPSPRGPDRPGGIEEEGGEQDRKRSTRLVSGFLAL
VWDDLRSLCLFLYHRLRDFILIAARAGELLGRSSLKGLRRGWEALKYLGS
LVQYWGLELKRSAISLLDTLAIAVGEGTDRILEFVLGICRAIRNIPTRIR
QGFETALLZ
>w160.A1
MRVRGIQRNYPQWWIWSMLGFWMLMICNGMWVTVYYGVPVWKEAKTTLFC
ASDAKAYEKEVHNVWATHACVPTDPNPQEMVLKNVTENFNMWENDMVDQM
HEDVISLWDQSLKPCVKLTPLCVTLNCINATNATDSKSNILEGMKNCSFN
ITTELRDKREKKNALFYKLDIVQLGGNSNSSQYRLINCNTSVITQACPKV
SFDPIPIHYCAPAGYAILKCNNKTFNGTGPCNNVSTVQCTHGIKPVVSTQ
LLLNGSLAEGEIIIRSKNITDNSKTIIVHLNESVKIECTRPSNNTRTSIR
IGPGQAFYATGQVIGNIREAHCNISESKWNETLQRVSEKLKEYFPQKNIT
FQPSSGGDLEITTHSFNCGGEFFYCNTSSLFNRTYMATGTDMANSTETNI
ITIHCRIKQIINMWQEVGRAMYAPPIAGNITCISNITGLLLTRDGGNSTE
DTETFRPVGGNMKDNWSSELYKYKVVEVKPLGVAPTNARRRVVEREKRAV
GMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSS
WSNKTYDDIWDNMTWMQWEREISNYTNIIYELLEESQNQQEKNEQDLLAL
DRWNSLWNWFNITNWLWYIKIFIMIVGGLIGLRIIFAVLSLVNRVRQGYS
PLSLQTLIPSPRGPDRPGGIEEEGGEQDRNRSTRLVSGFLALAWDDLRSL
CLFIYHRLRDFILIAARAGELLGRSSLKGLRRGWEALKYLGSLVQYWGLE
LKRSAISLLDTLAIAVGEGTDRILEFVLGICRAIRNIPTRIRQGFETALL
Z
>w160.C11
MRVRGIQRNYPQWWIWSMLGFWMLMICNGMWVTVYYGVPVWKEAKTTLFC
ASDAKAYEKEVHNVWATHACVPTDPNPQEMVLKNVTENFNMWENDMVDQM
HEDVISLWDQSLKPCVRLTPLCVTLNCINATNATASDSSILDGMKNCSFN
ITTELRDKREKKNALFYKLDIVQLGGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNSKTIIVHLNESVKIECTRPSNNTRTSIRIG
PGQAFYATGQVIGNIREAHCNISESKWNETLQRVSEKLKKYFPDKNITFQ
PSSGGDLEITTHSFNCGGEFFYCNTSSLFNRTYMATSTDLANSTETNIIT
IHCRIKQIINMWQEVGRAMYAPPIAGNITCISNITGLLLTRDGGNNTEDT
ETFRPVGGNMKDNWSSELYKYKVVEVKPLGVAPTNARRRVVKREKRAVGM
GAMFLGFLGAAGSTMGAASITLTVQARQLLSGIVQQQSNLLKAIEAQQHM
LKLTVWGIKQLQARVLALERYLKDQQLLGMWGCSGKLICTTNVYWNSSWS
NKTYDDIWDNMTWMQWEREISNYTELIYELLEESQNQQEKNEQDLLALDR
WNSLWNWFNITNWLWYIKIFIMIVGGLIGLRIIFAVLSLVNRVRQGYSPL
SLQTLIPSPRGPDRPGGIEEEGGEQDRNRSTRLVSGFLALAWDDLRSLCL
FIYHRLRDFILIAARAGELLGRSSLKGLRRGWEALKYLGSLVQYWGLELK
RSAISLLDTLAIAVGEGTDRILEFVLGICRAIRNIPTRIRQGFETALLZ
>w160.C12
MRVMGRQRNYPQWWIWSMLGLWMLMICNGMWVTVYYGVPVWKEAKTTLFC
ASDAKGYEKEVHNVWATHACVPTDPNPQEMVLKNVTENFNMWENDMVDQM
HEDVISLWDQSLKPCVKLTPLCVTLNCTDANATASNANATVSNTNATVSN
DSSIIEEMKNCSFNITTELRDKIEKKYALFYKLDIVQLDGNSTHYRFINC
NTSAITQACPKVSFDPIPIHYCAPAGYAILKCNNKTFNGTGPCNNVSTVQ
CTHGIKPVVSTQLLLNGSLAEGEIIIRSKNITDNGKTIIVHLNESVKIEC
TRPSNNTRTSIGIGPGQAFYATGQVIGDIRKAHCNISESKWNETLQRVSK
KLKEYFPGKNITFQPSSGGDPEVTTHSFNCGGEFFYCNTSSLFNRTYMTN
STDMANSTETNRTITIHCRIKQIINMWQEVGRAMYAPPIAGNITCISNIT
GLLLTRDGGNSSTETETFRPEGGNMKDNWRSELYKYKVVEVKPLGVAPTN
ARRRVVEREKRAVGMGAVFLGFLGAAGSTMGAASITLTVQARQLLSGIVQ
QQSNLLKAIEAQQHMLRLTVWGIKQLQARVLALERYLKDQQLLGMWGCSG

Fig. 17 (cont.)

```
KLICTTNVYWNSSWSNKTYDDIWDNMTWMQWEGEISNYTNIIYDLLEESQ
NQQEKNEQDLLALDRWNSLWNWFNITKWLWYIKIFIMIVGGLIGLRIIFA
VLSLVNRVRQGYSPLSLQTLIPSPRGPDRPGGIEEEGGEQDRKRSTRLVS
GFLALVWDDLRSLCLFLYHRLRDFILIAARAGELLGRSSLKGLRRGWEAL
KYLGSLVQYWGLELKGSAISLLDTLAIAVGEGTDRILEFVLGICRAIRNI
PTRIRQGFETALLZ
>w160.C14
MRVRGIQRSYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCINATNATDSKSNILEGMKNCSFN
ITTELRDKREKKNALFYKLDIVQLGSNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNSKTIIVHLNESVKIECTRPSNNTRTSIRIG
PGQAFYATGQVIGNIREAHCNISESKWNETLQRVSEKLKEYFPDKNITFQ
PSSGGDLEITTHSFNCGGEFFYCNTSSLFNRTYMANSTDMANSTETNSTQ
IITIHCRIKQIINMWQEVGRAMYAPPIAGNITCISNITGLLLTRDGGNNT
EDTETFRPVGGNMKDNWSSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYDDIWDNMTWMQWEREISNYTNIIYELLEESQNQQEKNEQDLLA
LDRWNSLWNWFNITNWLWYIKIFIMIVGGLIGLRIIFAVLSLVNRVRQGY
SPLSLQTLIPSPRGPDRPGGIEEEGGEQDRNRSTRLVSGFLALAWDDLRS
LCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETAL
LZ
>w160.C2
MRVRGIQRSYPQWWIWSMLGFWMLMICNGMWVTVYYGVPVWKEAKTTLFC
ASDAKAYEKEVHNVWATHACVPTDPNPQEMVLKNVTENFNMWENDMVDQM
HEDVISLWDQSLKPCVKLTPLCVTLNCINATNATASDSSILDGMKNCSFN
ITTELRDKREKKNALFYKLDIVQLGSNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNSKTIIVHLNESVKIECTRPSNNTRTSIRIG
PGQAFYATGQVIGNIREAHCNISESKWNETLQRVSEKLKEYFPDKKITFQ
PSSGGDLEITTHSFNCGGEFFYCNTSSLFNRTYMANSTDMANSTETNSTQ
IITIHCRIKQIINMWQEVGRAMYAPPIAGNITCISNITGLLLTRDGGNNT
EDTETFRPVGGNMKDNWSSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYDDIWDNMTWMQWEREISNYTEIIYELLEESQNQQEKNEQDLLA
LDRWNSLWNWFNITNWLWYIKIFIMIVGGLIGLRIIFAVLSLVNRVRQGY
SPLSLQTLIPSPRGPDRPGGIEEEGGEQDRNRSTRLVSGFLALAWDDLRS
LCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETAL
LZ
>w160.C4
MRVRGIQRSYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCINATNATDSKSNILEGMKNCSFN
ITTELRDKREKKNALFYKLDIVQLGGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNSKTIIVHLNESVKIECTRPSNNTRTSIRIG
PGQAFYATGQVIGNIREAHCNISESKWNETLQRVSEKLKEYFPDKNITFQ
PSSGGDLEITTHSFNCGGEFFYCNTSSLFNRTYMANSTDMANSTETNSTQ
IITIHCRIKQIINMWQEVGRAMYAPPIAGNITCISNITGLLLTRDGGNNT
EDTETFRPVGGNMKDNWSSELYKYKVVEVKPLGVAPTKARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYDDIWDNMTWMQWEREISNYTNIIYELLEESQNQQEKNEQDLLA
```

Fig. 17 (cont.)
LDRWNSLWNWFNITNWLWYIKIFIMIVGGLIGLRIIFAVLSLVNRVRQGY
SPLSLQTLIPSPRGPDRPGGIEEEGGEQDRNRSTRLVSGFLALAWDDLRS
LCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETAL
LZ
>w160.D1
MRVRGIQRSYPQWWIWSMLGLWMLMICNGMWVTVYYGVPVWKEAKTTLFC
ASDAKAYEKEVHNVWATHACVPTDPNPQEMVLKNVTENFNMWENDMVDQM
HEDVISLWDQSLKPCVRLTPLCVTLNCINATNATASDSSILDGMKNCSFN
ITTELRDKREKKNALFYKLDIVQLGGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNSKTIIVHLNESVKIECTRPSNNTRTSIRIG
PGQAFYATGQVIGNIREAHCNISESKWNETLQRVSEKLKKYFPDKNITFQ
PSSGGDLEITTHSFNCGGEFFYCNTSSLFNRTYMATSTDMANSTETNIIT
IHCRIKQIINMWQEVGRAMYAPPIAGNITCISNITGLLLTRDGGNNTEDT
ETFRPVGGNMKDNWSSELYKYKVVEVKPLGVAPTNARRRVVEREKRAVGM
GAVFLGFLGAAGSTMGAASITLTVQARQLLSGIVQQQSNLLKAIEAQQHM
LKLTVWGIKQLQARVLALERYLKDQQLLGMWGCSGKLICTTNVYWNSSWS
NKTYSDIWDNMTWMQWEREISNYTDMIYELLEESQNQQEKNEQDLLALDR
WNSLWNWFNITNWLWYIKIFIMIVGGLIGLRIIFAVLSLVNRVRQGYSPL
SLQTLIPSPRGPDRPGGIEEEGGEQDRNRSTRLVSGFLALAWDDLRSLCL
FIYHRLRDFILIAARAGELLGRSSLKGLRRGWEALKYLGSLVQYWGLELK
RSAISLLDTLAIAVGEGTDRILEFVLGICRAIRNIPTRIRQGFETALLZ
>w160.D5
MRVRGIQRSYPQWWIWSMLGFWMLMICNGMWVTVYYGVPVWKEAKTTLFC
ASDAKAYEKEVHNVWATHACVPTDPNPQEMVLKNVTENFNMWENDMVDQM
HEDVISLWDQSLKPCVKLTPLCVTLNCINATNATASDSSILDGMKNCSFN
ITTELRDKREKKNALFYKLDIVQLGSNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNSKTIIVHLNESVKIECTRPSNNTRTSIRIG
PGQAFYATGQVIGNIREAHCNISESKWNETLQRVSEKLKEYFPDKNITFQ
PSSGGDLEITTHSFNCGGEFFYCNTSSLFNRTYMANSTDMANSTETNSTQ
IITIHCRIKQIINMWQEVGRAMYAPPIAGNITCISNITGLLLTRDGGNNT
EDTETFRPVGGNMKDNWSSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYDDIWDNMTWMQWEREISNYTEIIYELLEESQNQQEKNEQDLLA
LDRWNSLWNWFNITNWLWYIKIFIMIVGGLIGLRIIFAVLSLVNRVRQGY
SPLSLQTLIPSPRGPDRPGGIEEEGGEQDRNRSTRLVSGFLALAWDDLRS
LCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETAL
LZ
>w160.T2
MRVRGIQRSYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCINATNATASDSSILDGMKNCSFN
ITTELRDKREKKNALFYKLDIVQLGGNSSQYRLINCNTSVITQACPKVSF
DPIPIHYCAPAGYAILKCNNKTFNGTGPCNNVSTVQCTHGIKPVVSTQLL
LNGSLAEGEIIIRSKNITDNSKTIIVHLNESVKIECTRPSNNTRTSIRIG
PGQAFYATGQVIGNIREAHCNISESKWNETLQRVSEKLKEYFPDKNITFQ
PSSGGDLEITTHSFNCGGEFFYCNTSSLFNRTYMANSTDMANSTETNSTQ
IITIHCRIKQIINMWQEVGRAMYAPPIAGNITCISNITGLLLTRDGGNNT
EDTETFRPVGGNMKDNWSSELYKYKVVEVKPLGVAPTNARRRVVEREKRA
VGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNS
SWSNKTYSDIWDNMTWMQWEREISNYTDMIYELLEESQNQQEKNEQDLLA
LDRWNSLWNWFNITNWLWYIKIFIMIVGGLIGLRIIFAVLSLVNRVRQGY
SPLSLQTLIPSPRGPDRPGGIEEEGGEQDRNRSTRLVSGFLALAWDDLRS Fig. 17 (cont.)
LCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETAL
LZ
>w160.T4
MRVMGRQRNYPQWWIWSTLGLRMLMICNGMWVTVYYGVPVWKEAKTTLFC
ASDAKAYEKEVHNVWATHACVPTDPNPQEMVLKNVTENFNMWENDMVDQM
HEDVISLWDQSLKPCVKLTPLCVTLNCTDANATASNANATVSNTNATVSN
DSSIIEEMKNCSFNITTELRDKIEKKYALFYKLDIVQLDGNSTHYRFINC
NTSAITQACPKVSFDPIPIHYCAPAGYAILKCNNKTFNGTGPCNNVSTVQ
CTHGIKPVVSTQLLLNGSLAEGEIIIRSENITDNAKTIIVHLNESVKIEC
TRPSNNTRTSIGIGPGQAFYATGQVIGDIRKAHCNISESKWNETLQRVSK
KLKEYFPGKNITFQPSSGGDPEVTTHSFNCGGEFFYCNTSSLFNRTYMTN
STDMANSTETNRTITIHCRIKQIINMWQEVGRAMYAPPIAGNITCISNIT
GLLLTRDGGNNTDPEIFRPGGGNMKDNWRSELYKYKVVEVKPLGVAPTNA
RRRVVEREKRAVGMGAVFLGFLGAAGSTMGAASITLTVQARQLLSGIVQQ
QSNLLKAIEAQQHMLRLTVWGIKQLQARVLALERYLKDQQLLGMWGCSGK
LICTTNVYWNSSWSNKTYGDIWDNMTWMQWESEISNYTNIIYDLLEESQN
QQEKNEQDLLALDRWNSLWNWFNITKWLWYIKIFIMIVGGLIGLRIIFAV
LSLVNRVRQGYSPLSLQTLIPSPRGPDRPGGIEEEGGEQDRKRSTRLVSG
FLALVWDDLRSLCLFLYHRLRDFILIAARAGELLGRSSLKGLRRGWEALK
YLGSLVQYWGLELKRSAISLLDTLAIAVGEGTDRILEFVLGICRAIRNIP
TRIRQGFETALLZ
>M5
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITKNVKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>M19
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNDKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ Fig. 17 (cont.)
>M10
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIRSENITNNGKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSRTIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>M11
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIRSENITDNGKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSRTIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>M9
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIRSKNITDNGKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSRTIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>M7
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT

Fig. 17 (cont.)
```
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSKNITDNSKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>M20
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNSGKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>M8
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNSAKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>M21
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNTAKTIIVHLNESVKIECTRPNNKTRTSIRIGPGQ
AFYATGQVIGDIREAYCNINESKWNETLQRVSKKLKEYFPHKNITFQPSS
```

Fig. 17 (cont.)

```
GGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ
>M6
MRVMGIQRNYPQWWIWSMLGFWMLMICNGMWVTVYYGVPVWKEAKTTLFC
ASDAKAYEKEVHNVWATHACVPTDPNPQEMVLKNVTENFNMWKNDMVDQM
HEDVISLWDQSLKPCVKLTPLCVTLNCTNATASNSSIIEGMKNCSFNITT
ELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNG
SLAEGEIIIRSENITNNAKTIIVHLNESVKIECTRPNNKTRTSIRIGPGQ
AFYATGQVIGDIREAYCNINESKWNETLQRVSKKLKEYFPHKNITFQPSS
GGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWN
SLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFI
YHRLRDFILIAARAGELLGRSSLKGLRRGWEALKYLGSLVQYWGLELKRS
AISLLDTLAIAVGEGTDRILEFVLGICRAIRNIPTRIRQGFETALLZ

>w014.12
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKP
VVSTQLLLNGSLAEGEIIIRSENITNNVKTIIVHLNESVKIECTRPNNKTRTSIRIGPGQ
AFYATGQVIGDIRAAYCNINESKWNETLQRVSKKLKEYFPHKNITFQPSPGGDLEITTHS
FNCGGEFFYCNTSSLFNRTYMANSTDMANSTETNNTRTITIHCRIKQIINMWQEVGRAMY
APPIAGNITCISNITGLLLTRDGGKNNAETFRPGGGNMKDNWRSELYKYKVVEVKPLGVA
PTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWNSLWNWFNITN
WLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGW
EALKYLGSLVQYWGLELKRSAISLLDTLAIAVGEGTDRILEFVLGICRAIRNIPTRIRQG
FETAFAI

>CH505.W4.26gp160

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNVKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIHCRIKQIINMWQEVGRAMYAPPIAGNITCISNITGLLLTRDGGKNNTETFRPGGGNMKDNWRSELYK
YKVVEVKPLGVAPTNVRRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQGYSPLSLQT
```

Fig. 17 (cont.)

LIPSPRGPDRPGGIEEEGGEQDRNRSTRLVSGFLALVWDDLRSLCLFIYHRLRDFILIAARAGELLGRSSLKGLRRGW
EALKYLGSLVQYWGLELKRSAISLLDTLAIAVGEGTDRILEFVLGICRAIRNIPTRIRQGFETALL

>CH505.W30.12gp160

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATNATASNSSIIEGMKNCSFNITTELR
DKREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNDKTIIVHLNESVKIECTRPSNKTRTSIRIGPGQAFYATGQVI
GDIREAYCNISESKWNETLQRVSKKLKEYFPHKNITFQPSSGGDLEITTHSFNCGGEFFYCNTSSLFNRTYMANSTDM
ANSTETNSTRNITIHCRIKQIIINMWQEVGRAMYAPPIAGNITCISNITGLLLTRDGGKNDTETFRPGGGNMKDNWRSE
LYKYKVVEVKPLGVAPTNARRRVVEREKRAVGMGAVFLGFLGAAGSTMGAASITLTVQARQLLSGIVQQQSNLLKAIE
AQQHMLKLTVWGIKQLQARVLALERYLKDQQLLGMWGCSGKLICTTNVYWNSSWSNKTYGDIWDNMTWMQWEREISNY
TEIIYELLEESQNQQEKNEQDLLALDRWNSLWNWFNITNWLWYIKIFIMIVGGLIGLRIIFAVLSLVNRVRQGYSPLS
LQTLIPSPRGPDRPGGIEEEGGEQDRNRSTRLVSGFLALVWDDLRSLCLFIYHRLRDFILIAARAGELLGRSSLKGLR
RGWEALKYLGSLVQYWGLELKRSAISLLDTLAIAVGEGTDRILEFILGICRAIRNIPTRIRQGFETALL

>CH505.W53.19gp160

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTDATASNATASNATASNSSIIEEMKNCSF
NITTELRDKREKKNALFYKLDIVQLDGNSSQYRLINCNTSAITQACPKVSFDPIPIHYCAPAGYAILKCNNKTFNGTG
PCNNVSTVQCTHGIKPVVSTQLLLNGSLAEGEIIIRSENITDNGKTIIVHLNESVKIECTRPSNNTRTSIRIGPGQAF
YATGQVIGDIREAHCNISESKWNETLQRVSKKLKEYFPHKNITFQPSSGGDLEITTHSFNCGGEFFYCNTSSLFNRTY
MANSTETNSTRIITIHCRIKQIINMWQEVGRAMYAPPIAGNITCISNITGLLLTRDGGNNNTETFRPGGGNMKDNWRS
ELYKYKVVEVKPLGVAPTNARRRVVEREKRAVGMGAVFLGFLGAAGSTMGAASITLTVQARQLLSGIVQQQSNLLKAI
EAQQHMLKLTVWGIKQLQARVLALERYLKDQQLLGMWGCSGKLICTTNVYWNSSWSNKTYGDIWDNMTWMQWEREISN
YTEIIYELLEESQNQQEKNEQDLLALDRWNSLWNWFNITNWLWYIKIFIMIVGGLIGLRIIFAVLSLVNRVRQGYSPL
SLQTLIPSPRGPDRPGGIEEEGGEQDRNRSTRLVSGFLALAWDDLRSLCLFIYHRLRDFILIAARAGELLGRSSLKGL
RRGWEALKYLGSLVQYWGLELKGSAISLLDTLAIAVGEGTDRILEFVLGICRAIRNIPTRIRQGFETALL

>CH505.w020.2gp160

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATANNSNIIEEMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNVKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTDMANSTETNNT
RTITIHCRIKQIINMWQEVGRAMYAPPIAGNITCISNITGLLLTRDGGKNNTETFRPGGGNMKDNWRSELYKYKVVEV
KPLGVAPTNARRRVVEREKRAVGMGAVFLGFLGAAGSTMGAASITLTVQARQLLSGIVQQQSNLLKAIEAQQHMLKLT
VWGIKQLQARVLALERYLKDQQLLGMWGCSGKLICTTNVYWNSSWSNKTYGDIWDNMTWMQWEREISNYTEIIYELLE
ESQNQQEKNEQDLLALDRWNSLWNWFNITNWLWYIKIFIMIVGGLIGLRIIFAVLSLVNRVRQGYSPLSLQTLIPSPR
GPDRPGGIEEEGGEQDRNRSTRLVSGFLALVWDDLRSLCLFIYHRLRDFILIAARAGELLGRSSLKGLRRGWEALKYL
GSLVQYWGLELKRSAISLLDTLAIAVGEGTDRILEFVLGICRAIRNIPTRIRQGFETALL

Fig. 18 (Amino acid sequences of CH505 D8gp120 constructs)

>HV1300531_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITKNVKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300532_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNAKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300533_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSKNITDNSKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300534_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNSAKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300535_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSKNITDNGKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNGKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

\>HV1300537_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITDNGKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

\>HV1300538_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNDKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

\>HV1300539_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNSGKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

\>HV1300540_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNTAKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

\>HV1300541_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI

Fig. 18 (cont.)
INMWQEVGRAMYAPPIAGNITCISNITGLLLTRDGGKNNTETFRPGGGNMKDNWRSELYKYKVVEVKPLGVAPTNARERV
VEREKE*

>HV1300542_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITKNVKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300543_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIRCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300544_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYVILKCNNKTFTGTGPCNNVSTVQCTHGIKPVVSTQLLL
NGSLAEGEIIIRSENITNNVKTIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTIKIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300545_v2

MRVMGIQRNYPQWWIWSMLGFWMLMICNGVPVWKEAKTTLFCASDAKAYEKEVHNVWATHACVPTDPNPQEMFLKNVTEN
FNMWKNDMVDQMHEDVISLWDQSLKPCVKLTPLCVTLNCTNATASNSSIIERMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRASIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIRCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300546_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCITLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNGKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRIITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300547_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL

Fig. 18 (cont.)
NGSLAEGEIIIRSENITNNGKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRIITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300548_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTIKIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300549_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNTNATASNSSTIEGMKNCSFNITTELRDKREKKNA
LFYKLDIVQLDGNSSQYRLINCNTSVITQACPKVSFDPIPIHYCAPAGYAILKCNNKTFTGTGPCNNVSTVQCTHGIKPV
VSTQLLLNGSLAEGEIIIRSENITNNAKTIIVHLNESVKIECTRPNNKTRTSIRIGPGQAFYATGQVIGNIREAYCNISE
SKWNETLQRVSKKLKEYFPHKNITFQPSSGGDLEITTHSFNCGGEFFYCNTSSLFNRTYMANSTDMANSTETNSTRIITI
HCRIKQIINMWQEVGRAMYAPPIAGNITCISNITGLLLTRDGGKNNTETFRPGGGNMKDNWRSELYKYKVVEVKPLGVAP
TNARERVVEREKE*

>HV1300550_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATANNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNGKTIIVHLNESVKIECTRPNNKTRTSIRIGPGQAFYATGQVIGDIREAYCNISESKWNETL
QRVSKKLKEYFPHKNITFQPSSGGDLEITTHSFNCGGEFFYCNTSSLFNRTYMANSTDMANSTETNSTRTITIRCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300551_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNANASNNSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNGKTIIVHLNESVKIECTRPNNKTRTSIRIGPGQAFYATGQVIGDIREAYCNISESKWNETL
QRVSKKLKEYFPHKNITFQPSSGGDLEITTHSFNCGGEFFYCNTSSLFNRTYMANSTDMANSTETNSTRIITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300552_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATANNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNAKTIIVHLNESVKIECTRPNNKTRTSIRIGPGQAFYATGQVIGNIREAYCNISESKWNETL
QRVSKKLKEYFPHKNITFQPSSGGDLEITTHSFNCGGEFFYCNTSSLFNRTYMANSTDMANSTETNSTRTITLHCRIKQI
INMWQEVGRAMYAPPIAGNITCISNITGLLLTRDGGKNNTETFRPGGGNMKDNWRSELYKYKVVEVKPLGVAPTNARERV
VEREKE*

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNAASNSSIIEGMKNCSFNITTELRDKREKKNALFYKLDIV
QLDGNSSQYRLINCNTSVITQACPKVSFDPIPIHYCAPAGYAILKCNNKTFTGTGPCNNVSTVQCTHGIKPVVSTQLLLN
GSLAEGEIIIRSENITNNAKTIIVHLNESVKIECTRPNNKTRTSIRIGPGQAFYATGQVIGDIRKAYCNINESKWNETLQ
RVSKKLKEYFPHKNITFQPSSGGDLEITTHSFNCGGEFFYCNTSSLFNRTYMANSTDMANSTETNNTRTITIHCRIKQII
NMWQEVGRAMYAPPIAGNITCISNITGLLLTRDGGKNNTETFRPGGGNMKDNWRSELYKYKVVEVKPLGVAPTNARERVV
EREKE*

>HV1300554_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATTSNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRTSIRIGPGQAFYATGQVIRNIREAYCNINESKWNETL
QRVSKKLKEYFPHKNITFQPSSGGDLEITTHSFNCGGEFFYCNTSSLFNRTYMANSTDMANSTETNSTRTIKIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300555_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNATASNSSIIEGMKNCSFNITTELRDKREKKNALF
YKLDIVQLDGNSSQYRLINCNTSVITQACPKVSFDPIPIHYCAPAGYAILKCNNKTFTGTGPCNNVSTVQCTHGIKPVVS
TQLLLNGSLAEGEIIIRSENITNNVKTIIVHLNESVKIECTRPNNKTRKSIRIGPGQAFYATGQVIGDIREAYCNINESK
WNETLQRVSKKLKEYFPHKNITFQPSSGGDLEITTHSFNCGGEFFYCNTSSLFNRTYMANSTDMANSTETNSTRTITIRC
RIKQIINMWQEVGRAMYAPPIAGNITCISNITGLLLTRDGGKNNTETFRPGGGNMKDNWRSELYKYKVVEVKPLGVAPTN
ARERVVEREKE*

>HV1300556_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNNSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNAKTIIVHLNESVKIECTRPNNKTRTSIRIGPGQAFYATGQVIGDIRKAYCNISESKWNETL
QRVSKKLKEYFPHKNITFQPSSGGDLEITTHSFNCGGEFFYCNTSSLFNRTYMANSTDMANSTETNSTRTITLHCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300557_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATTSNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRTSIRIGPGQAFYATGQVIGDIREAYCNISESKWNETL
QRVSKKLKEYFPHKNITFQPSSGGDLEITTHSFNCGGEFFYCNTSSLFNRTYMANSTDMANSTETNNTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300558_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNATASNSSIIEGMKNCSFNITTELRDKREKKNALF
YKLDIVQLDGNSSQYRLINCNTSVITQACPKVSFDPIPIHYCAPAGYAILKCNNKTFTGTGPCNNVSTVQCTHGIKPVVS
TQLLLNGSLAEGEIIIRSENITNNVKTIIVHLNESVKIECTRPNNKTRKSIRIGPGQAFYATGQVIGDIREAYCNISESK
WNETLQRVSKKLKEYFPHKNITFQPSSGGDLEITTHSFNCGGEFFYCNTSSLFNRTYMANSTDMANSTETNSTRTITIRC
RIKQIINMWQEVGRAMYAPPIAGNITCISNITGLLLTRDGGKNNTETFRPGGGNMKDNWRSELYKYKVVEVKPLGVAPTN
ARERVVEREKE*

Fig. 18 (cont.)
>HV1300559_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATTSNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRTSIRIGPGQAFYATGQVIGDIREAYCNISESKWNETL
QRVSKKLKEYFPHKNITFQPSSGGDLEITTHSFNCGGEFFYCNTSSLFNRTYMANSTDMANSTETNSTRTITIRCRIKQI
INMWQEVGRAMYAPPIAGNITCISNITGLLLTRDGGKNNTETFRPGGGNMKDNWRSELYKYKVVEVKPLGAAPTNARERV
VEREKE*

>HV1300560_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATTSNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNAKTIIVHLNESVKIECTRPNNKTRTSIRIGPGQAFYATGQVIGDIRKAYCNINESKWNETL
QRVSKKLKEYFPHKNITFQPSSGGDLEITTHSFNCGGEFFYCNTSSLFNRTYMANSTDMANSTETNNTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300561_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATTSNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNAKTIIVHLNESVKIECTRPNNKTRTSIRIGPGQAFYATGQVIGDIRKAYCNINESKWNETL
QRVSKKLKEYFPHKNITFQPSSGGDLEITTHSFNCGGEFFYCNTSSLFNRTYMANSTDMANSTETNSTRTITIRCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300562_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNISIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNGKTIIVHLNESVKIECTRPNNKTRTSIRIGPGQAFYATGQVIGDIREAYCNISESKWNETL
QRVSKKLKEYFPHKNITFQPSSGGDLEITTHSFNCGGEFFYCNTSSLFNRTYMANSTDMANSTETNSTRIITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300563_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATANATASNSSIIEGMKNCSFNITTELRDKREKKNALFY
KLDIVQLDGNSSQYRLINCNTSVITQACPKVSFDPIPIHYCAPAGYAILKCNNKTFTGTGPCNNVSTVQCTHGIKPVVST
QLLLNGSLAEGEIIIRSENITNNGKTIIVQLNESVKIECTRPNNKTRTSIRIGPGQAFYATGQVIGNIREAYCNISESKW
NETLQRVSKKLKEYFPHKNITFQPSSGGDLEITTHSFNCGGEFFYCNTSSLFNRTYMANSTDMANSTETNSTRIITIHCR
IKQIINMWQEVGRAMYAPPIAGNITCISNITGLLLTRDGGKNNTDTETFRPGGGNMKDNWRSELYKYKVVEVKPLGVAPT
NARERVVEREKE*

>HV1300564_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATTNATASNSSIIEGMKNCSFNITTELRDKREKKNALFY
KLDIVQLDGNSSQYRLINCNTSVITQACPKVSFDPIPIHYCAPAGYAILKCNNKTFTGTGPCNNVSTVQCTHGIKPVVST
QLLLNGSLAEGEIIIRSENITNNAKTIIVHLNESVKIECTRPSNKTRTSIRIGPGQAFYATGQVIGDIREAYCNISESKW
NETLQRVSKKLKEYFPHKNITFQPSSGGDLEITTHSFNCGGEFFYCNTSSLFNRTYMANSTDMANSTETNSTRTITIRCR

Fig. 18 (cont.)

IKQIINMWQEVGRAMYAPPIAGNITCISNITGLLLTRDGGKNNTDTETFRPGGGNMKDNWRSELYKYKVVEVKPLGVAPT
NARERVVEREKE*

>HV1300565_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATANATASNSSIIEGMKNCSFNITTELRDKREKKNALFY
KLDIVQLDGNSSQYRLINCNTSVITQACPKVSFDPIPIHYCAPAGYAILKCNNKTFNGTGPCNNVSTVQCTHGIKPVVST
QLLLNGSLAEGEIIIRSENITNNVKTIIVHLNESVKIECTRPNNKTRTSIRIGPGQAFYATGQVIGDIREAHCNISESKW
NKTLQRVSKKLKEYFPHKNITFQPSSGGDLEITTHSFNCGGEFFYCNTSSLFNRTYMANSTDMANSTETNSTRTITIRCR
IKQIINMWQEVGRAMYAPPIAGNITCISNITGLLLTRDGGKNNTDTETFRPGGGNMKDNWRSELYKYKVVEVKPLGVAPT
NARERVVEREKE*

>HV1300566_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATTSNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITDNVKTIIVHLNESVKIECTRPNNKTRTSIRIGPGQAFYATGQVIGDIREAYCNISESKWNETL
QRVSKKLKEYFPHKNITFQPSSGGDLEITTHSFNCGGEFFYCNTSSLFNRTYMANSTDMANSTETNSTRIITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300567_v2

MRVMGIQRNYPQWWIWSMLGFWMLMICKGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNISIEEMKNCSFNITTELRDKREKKNALFYKLDIV
QLDGNSSQYRLINCNTSVITQACPKVSFDPIPIHYCAPAGYAILKCNNKTFTGTGPCNNVSTVQCTHGIKPVVSTQLLLN
GSLAEGEIIIRSENITDNVKTIIVHLNESVKIECTRPNNKTRTSIRIGPGQAFYATGQVIGDIREAYCNISESKWNETLQ
RVSKKLKEYFPHKNITFQPSSGGDLEITTHSFNCGGEFFYCNTSSLFNRTYMANNSTETNSTRTITIRCRIKQIINMWQE
VGRAMYAPPIAGNITCISNITGLLLTRDGGKNNTDTETFRPGGGNMKDNWRSELYKYKVVEVKPLGVAPTNARERVVERE
KE*

>HV1300568_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKMTPLCVTLNCTNATAINSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNDKTIIVHLNESVKIECTRPNNKTRTSIRIGPGQAFYATGQVIGDIREAYCNISESKWNETL
QRVSKKLKEYFPHKNITFQPSSGGDLEITTHSFNCGGEFFYCNTSSLFNRTYMANSTDMANSTETNNTRPITIHCRIKQI
INMWQEVGRAMYAPPIAGNITCISNITGLLLTRDGGKNNTETFRPGGGNMKDNWRSELYKYKVVEVKPLGIAPTNARERV
VEREKE*

>HV1300569_v2

MRVMGIQRNYPQWWIWSMLGFWMLMICNGVPVWKEAKTTLFCASDAKAYEKEVHNVWATHACVPTDPNPQEMGLKNVTEN
FNMWKNDMVDQMHEDVISLWDQSLKPCVKLTPLCVTLNCTNATASNATASNSSIIEGMKNCSFNITTELRDKREKKNALF
YKLDIVQLDGNSSQYRLINCNTSVITQACPKVSFDPIPIHYCAPAGYAILKCNNKTFTGTGPCNNVSTVQCTHGIKPVVS
TQLLLNGSLAEGEIIIRSENITNNGKTIIVHLNESVKIECTRPNNKTRTSIRIGPGQAFYATGQVIGDIREAHCNISESK
WNETLQRVSKKLKEYFPHQNITFQPSSGGDLEITTHSFNCGGEFFYCNTSSLFNRTYMANSTDMANSTETNSTRTITIRC
RIKQIINMWQEVGRAMYAPPIAGNITCISNITGLLLTRDGGKNNTDTETFRPGGGNMKDNWRSELYKYKVVEVKPLGVAP
TNARERVVEREKE*

>HV1300570_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATNATASNSSIIEGMKNCSFNITTELRDKREKKNALFYK
LDIVQLDGNSSQYRLINCNTSVITQACPKVSFDPIPIHYCAPAGYAILKCNNKTFTGTGSCNNVSTVQCTHGIKPVVSTQ

Fig. 18 (cont.)

LLLNGSLAEGEIIIRSENITDNGKTIIVHLNESVKIECTRPNNKTRTSIRIGPGQAFYATGQVIGDIKEAYCNISESKWN
ETLQRVSKKLKEYFPHKNITFQPSSGGDLEITTHSFNCGGEFFYCNTSSLFNRTYMANSTDMANSTETNSTRNITIHCRI
KQIINMWQEVGRAMYAPPIAGNITCISNITGLLLTRDGGKNNTDTETFRPGGGNMKDNWRSELYKYKVVEVKPLGVAPTN
ARERVVEREKE*

>HV1300571_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATANATASNSSIIEGMKNCSFNITTELRDKREKKNALFY
KLDIVQLDGNSSQYRLINCNTSVITQACPKVSFDPIPIHYCAPAGYAILKCNNKTFTGTGPCNNVSTVQCTHGIKPVVST
QLLLNGSLAEGEIIIRSENITNNAKTIIVHLNESVKIECTRPNNKTRTSIRIGPGQAFYATGQVIGDIREAYCNISESKW
NETLQRVSKKLKEYFPHKNITFQPSSGGDLEITTHSFNCGGEFFYCNTSSLFNRTYMANSTDMANSTETNSTRIITIHCR
IKQIINMWQEVGRAMYAPPIAGNITCISNITGLLLTRDGGKNNPETFRPGGGNMKDNWRSELYKYKVVEVKPLGVAPTNA
RERVVEREKE*

>HV1300572_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATARNCTNATASNSSIIEGMKNCSFNITTELRDKREKKN
ALFYKLDIVQLDGNSSQYRLINCNTSVITQACPKVSFDPIPIHYCAPAGYAILKCNNKTFTGTGPCNNVSTVQCTHGIKP
VVSTQLLLNGSLAEGEIIIRSENITNSGKTIIVHLNESVKIECTRPNNKTRTSIRIGPGQAFYATGQVIGDIREAYCNIS
ESKWNETLQRVSKKLKEYFPHKNITFQPSSGGDLEITTHSFNCGGEFFYCNTSSLFNRTYMANSTDMANSTETNSTRIIT
IHCRIKQIINMWQEVGRAMYAPPIAGNITCISSITGLLLTRDGGENNTETFRPGGGNMKDNWRSELYKYKVVEVKPLGVA
PTNARERVVEREKE*

>HV1300573_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATTNATASNSSIIEGMKNCSFNITTELRDKREKKNALFY
KLDIVQLDGNSSQYRLINCNTSVITQACPKVSFDPIPIHYCAPAGYAILKCNNKTFTGTGPCNNVSTVQCTHGIKPVVST
QLLLNGSLAEGEIIIRSENITNNAKTIIVHLNESVKIECTRPNNKTRTSIRIGPGQAFYATGQVIGDIREAYCNISESKW
NETLQRVSKKLKEYFPHKNITFQPSSGGDLEITTHSFNCGGEFFYCNTSSLFNRTYMANSTDMANSTETNSTRIITIHCR
IKQIINMWQEVGRAMYAPPIAGNITCISNITGLLLTRDGGKNTRDGGKNNTETFRPGGGNMKDNWRSELYKYKVVEVKPL
GVAPTNARERVVEREKE*

>HV1300574_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATTNATASNSSIIEEMKNCSFNITTELRDKREKKNALFY
KLDIVQLDGNSSQYRLINCNTSVITQACPKVSFDPIPIHYCAPAGYAILKCNNKTFTGTGPCNNVSTVQCTHGIKPVVST
QLLLNGSLAEGEIIIRSENITNTAKTIIVHLNESVKIECTRPNNKTRTSIRIGPGQAFYATGQVIGDIREAYCNISESKW
NETLQRVSKKLKEYFPHKNITFQPSSGGDLEITTHSFNCGGEFFYCNTSSLFNRTYMANSTDMANSTETNSTRTITIRCR
IKQIINMWQEVGRAMYAPPIAGNITCISNITGLLLTRDGGENNTETFRPGGGNMKDNWRSELYKYKVVEVKPLGVAPTNA
RERVVEREKE*

>HV1300575_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNATASNSSIIEGMKNCSFNITTELRDKREKKNALF
YKLDIVQLDGNSSQYRLINCNTSVITQACPKVSFDPIPIHYCAPAGYAILKCNNKTFTGTGPCNNVSTVQCTHGIKPVVS
TQLLLNGSLAEGEIIIRSENITNNGKTIIVHLNESVKIECTRPSNKTRTSIRIGPGQAFYATGQVIGDIREAHCNISESK
WNETLQRVSKKLKEYFPHKNITFQPSSGGDLEITTHSFNCGGEFFYCNTSSLFNRTYMANSTDMANSTETNSTRTITLHC
RIKQIINMWQEVGRAMYAPPIAGNITCISNITGLLLTRDGGKNNTDTETFRPGGGNMKDNWRSELYKYKVVEVKPLGVAP
TNARERVVEREKE*

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATTNATASNSSIIEGMKNCSFNITTELRDKREKKNALFY
KLDIVQLDGNSSQYRLINCNTSVITQACPKVSFDPIPIHYCAPAGYAILKCNNKTFTGTGPCNNVSTVQCTHGIKPVVST
QLLLNGSLAEGEIIIRSENITNNAKTIIVHLNESVKIECTRPNNKTRTSIRIGPGQAFYATGQVIGDIREAHCNISESKW
NETLQRVSKKLKEYFPHKNITFQPSSGGDLEITTHSFNCGGEFFYCNTSSLFNRTYMANSTDMANSTETNSTRTITIRCR
IKQIINMWQEVGRAMYAPPIAGNITCISNITGLLLTRDGGKNNTDTETFRPGGGNMKDNWRSELYKYKVVEVKPLGVAPT
NARERVVEREKE*

>HV1300577_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNATASNSSIIEGMKNCSFNITTELRDKREKKNALF
YKLDIVQLDGNSSQYRLINCNTSVITQACPKVSFDPIPIHYCAPAGYAILKCNNKTFTGTGPCNNVSTVQCTHGIKPVVS
TQLLLNGSLAEGEIIIRSENITNNVKTIIVHLNESVKIECTRPNNKTRTSIRIGPGQAFYATGQVIGNIREAYCNISESK
WNETLQRVSKKLKEYFPHKNITFQPSSGGDLEITTHSFNCGGEFFYCNTSSLFNRTYMANSTDMANSTETNSTRIITIHC
RIKQIINMWQEVGRAMYAPPIAGNITCISNITGLLLTRDGGKNNTDTETFRPGGGNMKDNWRSELYKYKVVEVKPLGVAP
TNARERVVEREKE*

>HV1300578_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKMTPLCVTLNCTNATAINSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNDKTIIVHLNESVKIECTRPNNKTRTSIRIGPGQAFYATGQVIGDIREAHCNISESKWNETL
QRVSKKLKEYFPHKNITFQPSSGGDLEITTHSFNCGGEFFYCNTSSLFNRTYMANSTDMANSTETNSTRTITIRCRIKQI
INMWQEVGRAMYAPPIAGNITCISNITGLLLTRDGGKNNTETFRPGGGNMKDNWRSELYKYKVVEVKPLGVAPTNARERV
VEREKE*

>HV1300579_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATANATASNSSIIEGMKNCSFNITTELRDKREKKNALFY
KLDIVQLDGNSSQYRLINCNTSVITQACPKVSFDPIPIHYCAPAGYAILKCNNKTFNGTGPCNNVSTVQCTHGIKPVVST
QLLLNGSLAEGEIIIRSENITNNVKTIIVHLNESVKIECTRPNNKTRTSIRIGPGQAFYATGQVIGDIREAYCNISESKW
NETLQRVSKKLKEYFPHKNITFQPSSGGDLEITTHSFNCGGEFFYCNTSSLFNRTYMANSTDMANSTETNSTRTIKIHCR
IKQIINMWQEVGRAMYAPPIAGNITCISNITGLLLTRDGGKNNTDTETFRPGGGNMKDNWRSELYKYKVVEVKPLGVAPT
NARERVVEREKE*

>HV1300580_v2

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATNATASNSSILEGMKNCSFNITTELRDKREKKNALFYK
LDIVQLDGNSSQYRLINCNTSVITQACPKVSFDPIPIHYCAPAGYAILKCNNKTFNGTGPCNNVSTVQCTHGIKPVVSTQ
LLLNGSLAEGEIIIRSENITDNGKTIIVHLNESVKIECTRPSNNTRTSIRIGPGQAFYATGQVIGDIREAHCNISESKWN
ETLQRVSKKLKEYFPHKNITFQPSSGGDLEITTHSFNCGGEFFYCNTSSLFNRTYMANSTETNSTRTITLHCRIKQIINM
WQEVGRAMYAPPIAGNITCISNITGLLLTRDGGKNNTETFETFRPGGGNMKDNWRSELYKYKVVEVKPLGVAPTNARERV
VEREKE*

>HV1300581

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATNATASNSSILEGMKNCSFNITTELRDKREKKNALFYK
LDIVQLDGNSSQYRLINCNTSVITQACPKVSFDPIPIHYCAPAGYAILKCNNKTFNGTGPCNNVSTVQCTHGIKPVVSTQ
LLLNGSLAEGEIIIRSENITDNGKTIIVHLNESVKIECTRPSNNTRTSIRIGPGQAFYATGQVIGDIREAHCNISESKWN
ETLQRVSKKLKEYFPHKNITFQPSSGGDLEITTHSFNCGGEFFYCNTSSLFNRTYMANSTETNSTRTITIRCRIKQIINM
WQEVGRAMYAPPIAGNITCISNITGLLLTRDGGENNTETFETFRPGGGNMKDNWRSELYKYKVVEVKPLGVAPTNARERA
VEREKE*

MRVMGRQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTDATASNATASNSSIIEGMNSSIIEGMKNCSFNITTELRDK
REKKNALFYKLDIVQLDGNSSQYRLINCNTSVITQACPKVSFDPIPIHYCAPAGYAILKCNNKTFNGTGPCNNVSTVQCT
HGIKPVVSTQLLLNGSLAEGEIIIRSENITDNGKTIIVHLNESVKIECTRPSNNTRTSIRIGPGQAFYATGQVIGDIREA
HCNISESKWNETLQRVSEKLKEYFPHKNITFQPSSGGDLEITTHSFNCGGEFFYCNTSSLFNRTYMATSTDMANSTETNS
TRIITIRCRIKQIINMWQEVGRAMYAPPIAGNITCISNITGLLLTRDGGKNNTETFETFRPGGGNMKDNWRSELYKYKVV
EVKPLGVAPTNARERVVEREKE*

>HV1300583

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNANATASNSSIIEGMNSSIIEGMKNCSFNITTELRDKREK
KNALFYKLDIVQLDGNSSQYRLINCNTSVITQACPKVSFDPIPIHYCAPAGYAILKCNNKTFNGTGPCNNVSTVQCTHGI
KPVVSTQLLLNGSLAEGEIIRSENITDNGKTIIVHLNESVKIECTRPSNNTRTSIRIGPGQAFYATGQVIGDIREAHCN
ISESKWNETLQRVSEKLKEYFPHKNITFQPSSGGDLEITTHSFNCGGEFFYCNTSSLFNRTYMATSTDMANSTETNSTRI
ITIRCRIKQIINMWQEVGRAMYAPPIAGNITCISNITGLLLTRDGGKNNTETFETFRPGGGNMKDNWRSELYKYKVVEVK
PLGVAPTNARERVVEREKE*

>HV1300584

MRVMGIQRNYPQWWIWSMLGLWMLMICNGVPVWKEAKTTLFCASDAKAYEKEVHNVWATHACVPTDPNPQEMVLKNVTEN
FNMWENDMVDQMHEDVISLWDQSLKPCVKLTPLCVTLNCTDATASNATASNATASNSSIIEGMKNCSFNITTELRDKREK
KNALFYKLDIVQLDGNSSQYRLINCNTSVITQACPKVSFDPIPIHYCAPAGYAILKCNNKTFNGTGPCNNVSTVQCTHGI
KPVVSTQLLLNGSLAEGEIIRSENITDNGKTIIVHLNESVKIECTRPSNNTRTSIRIGPGQAFYATGQVIGDIREAHCN
ISENKWNETLQRVSKKLKEYFPHKNITFQPSSGGDLEITTHSFNCGGEFFYCNTSSLFNRTYMANSTDMANSTETNSTRT
ITIRCRIKQIINMWQEVGRAMYAPPIAGNITCISNITGLLLTRDGGKNNTETFETFRPGGGNMKDNWRSELYKYKVVEVK
PLGVAPTNARERVVEREKE*

>HV1300585

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTDATASNATAINSSIIEGMKNCSFNITTELRDKREKKNALF
YKLDIVQLDGNSSQYRLINCNTSVITQACPKVSFDPIPIHYCAPAGYAILKCNNKTFNGTGPCNNVSTVQCTHGIKPVVS
TQLLLNGSLAEGEIIIRSENITNNAKTIIVHLNESVKIECTRPSNNTRTSIRIGPGQAFYATGQVIGDIREAHCNISESK
WNETLQRVSKKLKEYFPHKNITFQPSSGGDLEITTHSFNCGGEFFYCNTSSLFNRTYMANSTETNSTRIITIRCRIKQII
NMWQEVGRAMYAPPIAGNITCISNITGLLLTRDGGKNNTETFETFRPEGGNMKDNWRSELYKYKVVEVKPLGVAPTNARE
RVVEREKE*

>HV1300586

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTDATASNATASNATASNSSIIEGMKNCSFNITTELRDKREK
KNALFYKLDIVQLDGNSSQYRLINCNTSVITQACPKVSFDPIPIHYCAPAGYAILKCNNKTFNGTGPCNNVSTVQCTHGI
KPVVSTQLLLNGSLAEGEIIRSENITDNGKTIIVHLNESVKIECTRPSNNTRTSIRIGPGQAFYATGQVIGDIREAHCN
ISESKWNETLQRVSKKLKEYFPHKNITFQPSSGGDLEITTHSFNCGGEFFYCNTSSLFNRTYMANSTETNSTRIITIRCR
IKQIINMWQEVGRAMYAPPIAGNITCISNITGLLLTRDGGNNNTETFRPGGGNMKDNWRSELYKYKVVEVKPLGVAPTNA
RERVVEREKE*

>HV1300587

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVRLTPLCVTLNCINATNATASNNSILEGMKNCSFNIATELRDKREKKNALFYK
LDIVQLDGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNGKTIIVHLNESVKIECTRPSNNTRTSIRIGPGQAFYATGQVIGNIREAHCNISESKWN
ETLQRVSKKLKEYFPDKNITFQPSSGGDLEITTHSFSCGGEFFYCNTSSLFNRTYMATNTDMANSTETNSTRIITIRCRI

Fig. 18 (cont.)
RQIINMWQEVGRAMYAPPIAGNITCISNITGLLLTRDGGENNTETFETFRPGGGNMKDNWRSELYKYKVVEVKPLGVAPT
NARERVVEREKE*

>HV1300588

MRVMGIQRNYPQWWIWSMLGLWMLMICNGVPVWKEAKTTLFCASDAKAYEKEVHNVWATHACVPTDPNPQEMVLKNVTEN
FNMWKNDMADQMHEDVISLWDQSLKPCVKLTPLCVTLNCTDATASNATASNATASNSSINSSIIEEMKNCSFNITTELRD
KREKKNALFYKLDIVQLDGNSSQYRLINCNTSAITQACPKVSFDPIPIHYCAPAGYAILKCNNKTFNGTGPCNNVSTVQC
THGIKPVVSTQLLLNGSLAEGEIIIRSENITDNGKTIIVHLNESVKIECTRPSNNTRTSIRIGPGQAFYATGQVIGDIRE
AHCNISESKWNETLQRVSKKLKEYFPHKNITFQPSSGGDLEVTTHSFNCGGEFFYCNTSSLFNRTDMANSTETNSTRIIT
IRCRIKQIVNMWQEVGRAMYAPPIAGNITCISNITGLLLTRDGGENNGGKNNTETFRPGGGNMKDNWRSELYKYKVVEVK
PLGVAPTNARERVVEREKE*

>HV1300589

MRVMGIQRNYTQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNVNATASNSSIIEGMNSSILEGMKNCSFNITTELRDKREK
KNALFYKLDIVQLGGNSSQYRLINCNTSVITQACPKVSFDPIPIHYCAPAGYAILKCNNKTFNGTGPCNNVSTVQCTHGI
KPVVSTQLLLNGSLAEGEIIIRSKNITDNGKTIIVHLNESVKIECTRPSNNTRTSIRIGPGQAFYATGQVIGDIREAHCN
ISESKWNETLQRVSEKLKEYFPDKNITFQPSSGGDLEITTHSFNCGGEFFYCNTSSLFNRTYMANSTDMANSTETNSTRI
ITIRCRIKQIINMWQEVGRAMYAPPIAGNITCISNITGLLLTRDGGENNTETFETFRPGGGNMKDNWRSELYKYKVVEVK
PLGVAPTNARERVVEREKE*

>HV1300590

MRVMGIQRNYPQWWIWSMLGLWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTDATASNATASNATASNATASNSSIIIEGMKNCSFNITTEL
RDKREKKNALFYKLDIVQLDGNSSQYRLINCNTSVITQACPKVSFDPIPIHYCAPAGYAILKCNNKTFNGTGPCNNVSTV
QCTHGIKPVVSTQLLLNGSLAEGEIIIRSKNITDNGKTIIVHLNESVKIECTRPSNNTRTSIRIGPGQAFYATGQVIGDI
REAHCNISESKWNETLQRVSKKLKEYFPQKNITFQPSSGGDLEITTHSFNCGGEFFYCNTSSLFNRTYMANSTDMANSTE
TNRTITIRCRIKQIINMWQEVGRAMYAPPIAGNITCISNITGLLLTRDGGKNNTETFETFRPGGGNMKDNWRSELYKYKV
VEVKPLGVAPTNARERVVEREKE*

>HV1300591

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCIDATASNATAINISIIEEMKNCSFNITTELRDKREKKNALF
YKLDIVQLDGNSSQHRLINCNTSVITQACPKVSFDPIPIHYCAPAGYAILKCNNKTFNGTGPCNNVSTVQCTHGIKPVVS
TQLLLNGSLAEGEIIIRSKNITDNGKTIIVHLNESVKIECTRPSNNTRTSIRIGPGQAFYATGQVIGNIREAHCNISESK
WNETLQRVSEKLKEYFPHKNITFQPSSGGDLEITTHSFNCGGEFFYCNTSSLFNRTYMATSTDMANSTETNSTRIITIRC
RIKQIINMWQEVGRAMYAPPIAGNITCISNITGLLLTRDGGKNDTDTETFRPEGGNMKDNWRSELYKYKVVEVKPLGVAP
TNARERVVEREKE*

>HV1300592

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLSCTNATNATASNSSILEGMKNCSFNITTELRDKREKKNALFYK
LDIVQLDGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNGKTIIVHLNESVKIECTRPSNNTRTSIRIGPGQAFYATGQVIGDIREAHCNISESKWN
ETLQRVSEKLKEYFPHKNITFQPSSGGDLEITTHSFNCGGEFFYCNTSSLFNRTYMATSTDMANSTETNSTRIITIRCRI
KQIINMWQEVGRAMYAPPIAGNITCISNITGLLLTRDGGKNDTDTFRPEGGNMKDNWRSELYKYKVVEVKPLGVAPTNAR
ERVVEREKE*

>HV1300593

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLDCINATNATASNSSILEGMKNCSFNITTELRDKREKKNALFYK
LDIVQLGGNSSQYRLINCNTSVITQACPKVSFDPIPIHYCAPAGYAILKCNNKTFNGTGPCNNVSTVQCTHGIKPVVSTQ

Fig. 18 (cont.)

LLLNGSLAEGEIIIRSKNITDNGKTIIVHLNESVKIECTRPSNNTRTSIRIGPGQAFYATGQVIGDIREAHCNISESKWN
ETLQRVSKKLKEYFPDKNITFQPSSGGDLEITTHSFNCGGEFFYCNTSSLFNRTYMVNSTDMANSTETNSTRTITIRCRI
KQIINMWQEVGRAMYAPPIAGNITCISNITGLLLTRDGGENNTETFETFRPGGGNMKDNWRSELYKYKVVEVKPLGVAPT
NARERVVEREKE*

>HV1300594

MRVMGRQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLTPCVKLTPLCVTLNCTDATASNATASNATASNATASNSSIEGMKNCSFNITTELRD
KREKKNALFYKLDIVQLDGNSSQYRLINCNTSVITQACPKVSFDPIPIHYCAPAGYAILKCNNKTFNGTGPCNNVSTVQC
THGIKPVVSTQLLLNGSLAEGEIIIRSKNITDNGKTIIVHLNESVKIECTRPSNNTRTSIRIGPGQAFYATGQVIGDIRE
AHCNISESKWNETLQRVSEKLKEYFPNKNITFQPSSGGDLEITTHSFNCGGEFFYCNTSSLFNRTYMANSTDMANSTETN
STRIITIRCRIKQIINMWQEVGRAMYAPPIAGNITCISNITGLLLTRDGGKNNTETFETFRPGGGNMKDNWRSELYKYKV
VEVKPLGVAPTNARERVVEREKE*

>HV1300595

MRVTGIQRNYPQWWIWSMLGLWMLMICNGVPVWKEAKTTLFCASDAKAYEKEVHNVWATHACVPTDPNPQEMVLKNVTEN
FNMWKNDMADQMHEDVISLWDQSLKPCVKLTPLCVTLNCIDANATASNATASNSSIIEGMKNCSFNITTELRDKIEKKNA
LFYKLDIVQLDGNSSQYRLINCNTSVITQACPKVSFDPIPIHYCAPAGYAILKCNNKTFNGTGPCNNVSTVQCTHGIKPV
VSTQLLLNGSLAEGEIIIRSENITNSAKTIIVHLNESVKIECTRPSNNTRTSIRIGPGQAFYATGQVIGDIRKAHCNISE
SKWNETLQRVSKKLKEYFPHKNITFQPSSGGDLEITTHSFNCGGEFFYCNTSSLFNRTYMANSTETNSTRTITLHCRIKQ
IINMWQEVGRAMYAPPIAGNITCISNITGLLLTRDGGNNNTTETFRPGGGNMKDNWRSELYKYKVVEIKPLGVAPTNARE
RVVEREKE*

>HV1300596

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCIDATASNATAINISIIEEMKNCSFNITTELRDKREKKNALF
YKLDIVQLDGNSSQHRLINCNTSVITQACPKVSFDPIPIHYCAPAGYAILKCNNKTFNGTGPCNNVSTVQCTHGIKPVVS
TQLLLNGSLAEGEIIIRSKNITDNGKTIIVHLNESVKIECTRPSNNTRTSIRIGPGQAFYATGQVIGNIREAHCNISKSK
WNETLQRVSEKLKEYFPHKNITFQPSSGGDLEITTHSFNCGGEFFYCNTSSLFNRTYMATSTDMANSTETNSTRIITIRC
RIKQIINMWQEVGRAMYAPPIAGNITCISNITGLLLTRDGGKNDTDTETFRPEGGNMKDNWRSELYKYKVVEVKPLGVAP
TNARERVVEREKE*

>HV1300597

MRVMGIQKNCPQWWIWSMLGLWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTDANATASNSSIIKGMNSSMIEEMKNCSFNITTELRDKREK
KNALFYKLDIVQLDGNSSQYRLINCNTSVITQACPKVSFDPIPIHYCAPAGYAILKCNNKTFNGTGPCNNVSTVQCTHGI
KPVVSTQLLLNGSLAEGEIIIRSKNITDNGKTIIVHLNESVKIECTRPSNNTRTSIRIGPGQAFYATGQVIGDIREAHCN
ISESKWNETLQRVSKKLKEYFPQKDITFQPSSGGDLEITTHSFNCGGEFFYCNTSSLFNRTYMATSTDMANSTETNSTRI
ITIRCRIKQIINMWQEVGRAMYAPPIAGNITCISNITGLLLTRDGGENDTDTETFRPEGGNMKDNWRSELYKYKVVEVKP
LGVAPTNARERVVEREKE*

>HV1300598

MRVMGIQRSYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVRLTPLCVTLNCINATNATASNSSILEGMKNCSFNITTELRDKREKKNALFYK
LDIVQLDGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNGKTIIVHLNESVKIECTRPSNNTRTSIRIGPGQAFYATGQVIGDIREAHCNISESKWN
ETLQRVSEKLKEYFPDKNITFQPSSGGDLEITTHSFNCGGEFFYCNTSNLFNRTYMVNSTDMANSTETNSTRTITISCRI
KQIINMWQEVGRAMYAPPIAGNITCISNITGLLLTRDGGKNDTDTETFRPEGGNMKDNWRSELYKYKVVEVKPLGVAPTN
ARERVVEREKE*

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCINATNATASNSSILEGMKNCSFNITTELRDKREKKNALFYK
LDIVQLDGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNGKTIIVHLNESVKIECTRPSNNTRTSIRIGPGQAFYATGQVIGNIREAHCNISESKWN
ETLQRVSEKLKEYFPQKNITFQPSSGGDLEITTHSFNCGGEFFYCNTSSLFNRTYMATSTDMANSTETNSTRIITIRCRI
KQIINMWQEVGRAMYAPPIAGNITCISNITGLLLTRDCGNDTDTETFRPEGGNMKDNWRSELYKYKVVEVKPLGVAPTNA
RERVVEREKE*

>HV1300600

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTDATNATASNSSILGGMKNCSFNITTELRDKREKKNALFYK
LDIVQLDGNSSQYRLINCNTSAITQACPKVSFDPIPIHYCAPAGYAILKCNNKTFNGTGPCNNVSTVQCTHGIKPVVSTQ
LLLNGSLAEGEIIIRSKNITDNGKTIIVHLNESVKIECTRPSNNTRTSIRIGPGQAFYATGQVIGDIREAHCNISESKWN
ETLQRVSEKLKEYFPDKNITFQPSSGGDLEITTHSFNCGGEFFYCNTSSLFNRTYMANSTDMANSTETNSTRIITIRCRI
KQIINMWQEVGRAMYAPPIAGNITCISNITGLLLTRDGGKNDTDTETFRPEGGNMKDNWRSELYKYKVVEVKPLGVAPTN
ARERVVEREKE*

>HV1300601

MRVRGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVRLTPLCVTLNCINATNATASNSSILEGMKNCSFNITTELRDKREKKNALFYK
LDIVQLDGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNGKTIIVHLNESVKIECTRPSNNTRTSIRIGPGQAFYATGQVIGDIREAHCNISESKWN
ETLQRVSEKLKEYFPDKNITFQPSSGGDLEITTHSFNCGGEFFYCNTSSLFNRTYMANSTDMANSTETNSTRIITLHCRI
KQIINMWQEVGRAMYAPPIAGNITCISNITGLLLTRDGGNDTDTETFRPEGGNMKDNWRSELYKYKVVEVKPLGVAPTNA
RERVVEREKE*

>HV1300602

MRVMGIQRNYPQWWIWSMLGLWMLMICNGVPVWKEAKTTLFCASDAKAYEKEAHNVWATHACVPTDPNPQEMVLKNVTEN
FNMWKNDMADQMHEDVISLWDQSLKPCVKLTPLCVTLNCTDANATASNANATASNTNATVSNSSIIEEMKNCSFNITTEL
RDKREKKYALFYKLDIVQLDGNSSQYRLINCNTSVITQACPKVSFDPIPIHYCAPAGYAILKCNNKTFNGTGPCNNVSTV
QCTHGIKPVVSTQLLLNGSLAEGEIIIRSENITNSAKTIIVHLNESVKIECTRPSNNTRTSIRIGPGQAFYATGQVIGDI
RKAHCNISESKWNETLQRVSKKLKEYFPHKNITFQPSSGGDPEITTHSFNCGGEFFYCNTSSLFNRTYMANSTETNSTRT
ITLHCRIKQIINMWQEVGRAMYAPPIAGNITCISNITGLLLTRDGGENTRDGGNNNTETFRPGGGNMKDNWRSELYKYKV
VEVKPLGVAPTNARERVVEREKE*

>HV1300603

MRVMGIQRNYPQWWIWSMLGLWMLMICNGVPVWKKAKTTLFCASDAKAYEKEVHSVWATHACVPTDPNPQEMVLKNVTEN
FNMWKNDMVDQMHEDVISLWDQSLKPCVKLTPLCVTLNCTDANATASNSSIIKGMNSSMIEEMKNCSFNITTELRDKREK
KNALFYKLDIVQLDGNSSQYRLINCNTSVITQACPKVSFDPIPIHYCAPAGYAILKCNNKTFNGTGPCNNVSTVQCTHGI
KPVVSTQLLLNGSLAEGEIIIRSENITNSAKTIIVHLNESVKIECTRPSNNTRTSIRIGPGQAFYATGQVIGDIRKAHCN
ISESKWNETLQRVSKKLKEYFPDRNITFQPSSGGDPEITTHSFNCGGKFFYCNTSSLFNRTYMANSTDMANSTETNSTRI
ITIRCRIKQIINMWQEVGRAMYAPPIAGNITCISNITGLLLTRDGGNNNTETFRPVGGNMKDNWRSKLYKYKVVEVKPLG
VAPTKARERMVEREKE*

>HV1300604

MRVMGRQRNYPQWWIWSMLGLWMLMICNGVPVWKEAKTTLFCASDAKAYEKEVHNVWATHACVPTDPNPQEMVLKNVTEN
FNMWENDMVDQMHEDVISLWDQSLKPCVKLTPLCVTLNCTDANATASNTNATASNINATASKNSIIEEMKNCSFNITTEL
RDKREKKYALFYKLDIVQLDGNSSQYRLINCNTSVITQACPKVSFDPIPIHYCAPAGYAILKCNNKTFNGTGPCNNVSTV
QCTHGIKPVVSTQLLLNGSLAEGEIIIRSKNITDNGKTIIVHLNESVKIECTRPSNNTRTSIRIGPGQAFYATGQVIGDI
REAHCNISESKWNETLQRVSKKLKEYFPDKNITFQSSSGGDPEITTHSFNCGGEFFYCNTSSLFNRTYMANSTDMANSTE
TNSTRIITIRCRIKQIINMWQEVGRAMYAPPIAGNITCISNITGLLLTRDGGNSSTETFRPEGGNMKDNWRSELYKYKVV
EVKPLGVAPTNARERVVEREKE*

Fig. 18 (cont.)
>HV1300605

MKVRGIQRNYPQWWIWSMLGLWMLMICNGVPVWKEAKTTLFCASDAKAYEKEVHNVWATHACVPTDPNPQEMVLENVTEN
FNMWKNDMADQMHEDVISLWDQSLKPCVKLTPLCVTLNCTDANATASNTNATASNINATASKSSIIEEMKNCSFNITTEL
RDKREKKYALFYKLDIVQLDGNSSQYRLINCNTSVITQACPKVSFDPIPIHYCAPAGYAILKCNNKTFNGTGPCNNVSTV
QCTHGIKPVVSTQLLLNGSLAEGEIIIRSENITDNSKTIIVHLNESVKIECTRPSNNTRTSIRIGPGQAFYATGQVIGDI
REAHCNISESKWNETLQRVSKKLKEYFPDKNITFQPSSGGDPEITTHSFNCGGEFFYCNTSSLFNRTYMANSTETNSTRT
ITLHCRIKQIINMWQEVGRAMYAPPIAGNITCISNITGLLLTRDGGENTRDGGNNNTETFRPEGGNMKDNWRSELYKYKV
VEVKPLGVAPTKARERVVEREKE*

>HV1300606

MRVMGIQRNYPQWWIWSMLGFWMLMICNGVPVWKEAKTTLFCASDAKAYEKEVHNVWATHACVPTDPNPQEMVLKNVTEN
FNMWKNDMADQMHEDVISLWDQSLKPCVKLTPLCVTLNCTDANATASNINATASKSSIIEEMKNCSFNITTELRDKREKK
YALFYKLDIVQLDGNSSQYRLINCNTSVITQACPKVSFDPIPIHYCAPAGYAILKCNNKTFNGTGPCNNVSTVQCTHGIK
PVVSTQLLLNGSLAEGEIIIRSENITDNSKTIIVHLNESVKIECTRPSNNTRTSIRIGPGQAFYATGQVIGDIREAHCNI
SESKWNETLQRVSKKLKEYFPDKNITFQPSSGGDPEITTHSFNCGGEFFYCNTSSLFNRTYMANSTETNSTRTITLHCRI
KQIINMWQEVGRAMYAPPIAGNITCISNITGLLLTRDGGENTRDGGNNNTETFRPEGGNMKDNWRSELYKYKVVEVKPLG
VAPTKARERVVEREKE*

>HV1300607

MRVMGIQRNYPQWWIWSMLGLWMLMTCNGVPVWKEAKTTLFCASDAKAYEKEVHNVWATHACVPTDPNPQEMVLKNVTEN
FNMWENDMVDQMHEDVISLWDQSLKPCVKLTPLCVTLNCTDANATASNTNATASNINATASKSSIIEEMKNCSFNITTEL
RDKREKKYALFYKLDIVQLDGNSSQYRLINCNTSVITQACPKVSFDPIPIHYCAPAGYAILKCNNKTFNGTGPCNNVSTV
QCTHGIKPVVSTQLLLNGSLAEGEIIIRSKNITDNGKTIIVHLNESVKIECTRPSNNTRTSIRIGPGQAFYATGQVIGDI
REAHCNISESKWNETLQRVSKKLKEYFPDKNITFQSSSGGDPEITTHSFNCGGEFFYCNTSSLFNRTYMANSTDMANSTE
TNSTRIITIHCRIKQIINMWQEVGRAMYAPPIAGNITCISNITGLLLTRDGGENNGGKNNTETFRPGGGNMKDNWRSELY
KYKVVEVKPLGVAPTKARERVVEREKE*

>HV1300608

MRVRGIQRNYPQWWIWSMLGLWMLMICNGVPVWKEAKTTLFCASDAKAYEKEAHNVWATHACVPTDPNPQEMVLKNVTEN
FNMWENDMVDQMHEDVISLWDQSLKPCVKLTPLCVTLNCTDANATASNTNATVSNIKATVSNSSIIEEMKNCSFNITTEL
RDKIEKKYALFYKLDIVQLDGNSTQYRFINCNTSAITQACPKVSFDPIPIHYCAPAGYAILKCNNKTFNGTGPCNNVSTV
QCTHGIKPVVSTQLLLNGSLAEGEIIIRSENITDNGKTIIVHLNESVKIECTRPGNNTRTSIRIGPGQAFYATGQVIGDI
RQAHCNISESKWNETLQRVSEKLKEYFPNKTITFQPSSGGDPEITTHSFNCGGEFFYCNTSSLFNRTYMANSTETNSTRT
ITLHCRIKQIINMWQEVGRAMYAPPIAGNITCISNITGLLLTRDGGNTTDIETFRPGGGNMKDNWRSELYKYKVVEVKPL
GVAPTKARERVVEREKE*

>HV1300609

MRVRGIQRNYPQWWIWSMLGLWMLMICNGVPVWKEAKTTLFCASDAKAYEKEAHNVWATHACVPTDPNPQEMVLKNVTEN
FNMWENDMVDQMHEDVISLWDQSLKPCVKLTPLCVTLNCTDANATASNANATASNTNATVSNDSSIIEEMKNCSFNITTE
LRDKIEKKYALFYKLDIVQLDGNSTQYRFINCNTSAITQACPKVSFDPIPIHYCAPAGYAILKCNNKTFNGTGPCNNVST
VQCTHGIKPVVSTQLLLNGSLAEGEIIIRSKNITDNGNTIIVHLNESVKIECTRPSNNTRTSIRIGPGQAFYATGQVIGD
IRQAHCNISESKWNETLQRVSEKLKEYFPDKNITFQPSSGGDPEITTHSFNCGGEFFYCNTSSLFNRTYMANSTETNSTR
TITLHCRIKQIINMWQEVGRAMYAPPIAGNITCISNITGLLLTRDGGNSSKETETFRPGGGNMKDNWRSELYKYKVVEVK
PLGVAPTNARERVVEREKE*

>HV1300610

MRVRGIQRSYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCINATNATDSNSNILEGMKNCSFNITTELRDKREKKNALFYK
LDIVQLGGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNSKTIIVHLNESVKIECTRPSNNTRTSIRIGPGQAFYATGQVIGNIREAHCNISESKWN
ETLQRVSEKLKKYFPDKNITFRPSSGGDLEITTHSFNCGGEFFYCNTSSLFNRTYMATSTDMANSTETNSTRIITIHCRI

Fig. 18 (cont.)
KQIINMWQEVGRAMYAPPIAGNITCISNITGLLLTRDGGNNTEDTETFRPEGGNMKDNWRSELYKYKVVEVKPLGVAPTN
ARERVVEREKE*

>HV1300611

MRVMGTQRNYPQWWIWSMLGLWMLMICNGVPVWKEAKTTLFCASDAKAYEKEVHNVWATHACVPTDPNPQEMVLKNVTEN
FNMWKNDMADQMHEDVISLWDQSLKPCVKLTPLCVTLYCINATANATVSNSSIIEEMKNCSFNITTELRDKREKKNALFY
KLDIVQLDGNSSQYRLINCNTSAITQACPKVSFDPIPIHYCAPAGYAILKCNNKTFNGTGPCNNVSTVQCTHGIKPVVST
QLLLLNGSLAEGEIIIRSENITNSAKTIIVHLNESVKIECTRPSNNTRTSIRIGPGQAFYATGQVIGDIRQAHCNISESKW
NETLQRVSEKLKEYFPNKTITFQPSSGGDPEITTHSFNCGGEFFYCNTSSLFNRTYMANSTDMANSTETNSTRTITLHCR
IKQIINMWQEVGRAMYAPPIAGNITCISNITGLLLTRDGGNSSKETETFRPGGGNMKDNWRSELYKYKVVEVKPLGVAPT
NARERVVEREKE*

>HV1300612

MRVRGIQRSYPQWWIWSMLGFWMLMICNGVPVWKEAKTTLFCASDAKAYEKEVHNVWATHACVPTDPNPQEMVLKNVTEN
FNMWENDMVDQMHEDVISLWDQSLKPCVKLTPLCVTLNCINATNATDSNSNILEGMKNCSFNITTELRDKREKKNALFYK
LDIVQLGGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNSKTIIVHLNESVKIECTRPSNNTRTSIRIGPGQAFYATGQVIGNIREAHCNISESKWN
ETLQRVSEKLKKYFPDKNITFRPSSGGDLEITTHSFNCGGEFFYCNTSSLFNRTYMATSTDMANSTETNSTRIITIHCRI
KQIINMWQEVGRAMYAPPIAGNITCISNITGLLLTRDGGNNTEDTETFRPEGGNMKDNWRSELYKYKVVEVKPLGVAPTN
ARERVVEREKE*

>HV1300613

MRVMGIQRSYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLSCINATNATDSNNSILEGMKNCSFNITTELRDKREKKNALFYK
LDIVQLYGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNGKTIIVHLNESVKIECTRPSNNTRTSIRIGPGQAFYATGQVIGNIREAHCNISESKWN
ETLQRVSEKLKEYFPDKNITFQPSSGGDLEITTHSFNCGGEFFYCNTSSLFNRTYMATSTDMANSTETNSTRIITIHCRI
KQIINMWQEVGRAMYAPPIAGNITCISNITGLLLTRDGGNNTEDTETFRPEGGNMKDNWRSELYKYKVVEVKPLGVAPTN
ARERVVEREKE*

>HV1300614

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCINATNATDSNSNILEGMKNCSFNITTELRDKREKKNALFYK
LDIVQLGGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNSKTIIVHLNESVKIECTRPSNNTRTSIRIGPGQAFYATGQVIGNIREAHCNISESKWT
ETLQRVSEKLKKYFPDKNITFRPSSGGDLEITTHSFNCGGEFFYCNTSSLFNRTYMATSTDMANSTEINSTRIITIHCRI
KQIINMWQEVGRAMYAPPIAGNITCISNITGLLLTRDGGNNTEDTETFRPEGGNMKDNWRSELYKYKVVEVKPLGVAPTN
ARERVVEREKE

>HV1300615

MRVMGRQRNYPQWWIWSMLGLWMLMICNGVPVWKEAKTTLFCASDAKAYEKEVHNVWATHACVPTDPNPQEMVLKNVTEN
FNMWKNDMVDQMHEDVISLWDQSLTPCVKLTPLCVTLNCTDANDTASNSSIIKGMNNSIVGEMKNCSFNITTELRDKREK
KNALFYKLDIVQLDGNSSEYRLINCNTSVITQACPKVSFDPIPIHYCAPAGYAILKCNNKTFNGTGPCNNVSTVQCTHGI
KPVVSTQLLLNGSLAEGEIIIRSENITDNAKTIIVHLNESVKIECTRPSNNTRTSIRIGPGQAFYATGQVIGDIRKAHCN
ISESKWNETLQRVSKKLKEYFPDKNITFQPSSGGDPEITTHSFNCGGEFFYCNTSSLFNRTYMANSTDMANSAETNSTRT
ITLHCRIKQIINMWQEVGRAMYAPPIAGNITCISNITGLLLTRDGGNSSTETETFRPGGGNMKDNWRSELYKYKVVEVKP
LGVAPTNARERVVEREKE*

>HV1300616

MRVRGIQRSYPQWWIWSMLGFWMLMICNGVPVWREAKTTLFCASDAKAYEKEVHNVWATHACVPTDPNPQEMVLKNVTEN
FNMWENDMVDQMHEDVISLWDQSLKPCVKLTPLCVTLNCINATNATDSNSNILEGMKNCSFNITTELRDKREKKNALFYK
LDIVQLGGNSSQYRLINCNTSVITQACPKVSFDPIPIHYCAPAGYAILKCNNKTFNGTGPCNNVSTVQCTHGIKPVVSTQ

Fig. 18 (cont.)

LLLNGSLAEGEIIIRSKNITDNSKTIIVHLNESVKIECTRPSNNTRTSIRIGPGQAFYATGQVIGNIREAHCNISESKWN
ETLQRVSKKLKKYFPDKNITFRPSSGGDLEITTHSFNCGGEFFYCNTSSLFNRTYMATSIDMANSTETNSTRIITIHCRI
KQIINMWQEVGRAMYAPPIAGNITCISNITGLLLTRDGGNNTEDTETFRPEGGNMKDNWRSELYKYKVVEVKPLGVAPTN
ARERVVEREKE*

>HV1300617

MRVRGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCINATNATASNSNILEGMKNCSFNITTELRDKREKKNALFYK
LDIVQLGGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNSKTIIVHLNESVKIECTRPSNNTRTSIRIGPGQAFYATGQVIGNIREAHCNISESKWN
ETLQRVSEKLKEYFPDKNITFQPSSGGDLEITTHSFNCGGEFFYCNTSSLFNRTYMANSTDMANSTETNSTRIITLHCRI
KQIINMWQEVGRAMYAPPIAGNITCISNITGLLLTRDGGNNTEDTETFRPEGGNMKDNWRSELYKYKVVEVKPLGVAPTN
ARERVVEREKE*

>HV1300618

MRVRGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCINATNATDSNSNILEGMKNCSFNITTELRDKREKKNALFYK
LDIVQLGGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNSKTIIVHLNESVKIECTRPSNNTRTSIRIGPGQAFYATGQVIGNIREAHCNISESKWN
ETLQRVSEKLKKYFPDKNITFRPSSGGDLEITTHSFNCGGEFFYCNTSSLFNRTYMATSTDMANSTETNSTRIITIHCRI
KQIINMWQEVGRAMYAPPIAGNITCISNITGLLLTRDGGNNTEDTETFRPEGGNMKDNWRSELYKYKVVEVKPLGVAPTN
ARERVVEREKE*

>HV1300619

MRVRGIQRSYPQWWIWSMLGFWMLMICNGVPVWKEAKTTLFCASDAKAYEKEVHNVWATHACVPTDPNPQEMVLKNVTEN
FNMWENDMVDQMHEDVISLWDQSLKPCVKLTPLCVTLNCINATNATDSNSNILEGMKNCSFNITTELRDKREKKNALFYK
LDIVQLGGNSSQYRLINCNTSVITQACPKVSFDPIPIHYCAPAGYAILKCNNKAFNGTGPCNNVSTVQCTHGIKPVVSTQ
LLLNGSLAEGEIIIRSKNITDNSKTIIVHLNESVKIECTRPSNNTRTSIRIGPGQAFYATGQVIGNIREAHCNISESKWN
ETLQRVSEKLKKYFPDKNITFRPSSGGDLEITTHSFNCGGEFFYCNTSSLFNRTYMATSTDMANSTETNSTRIITIHCRI
KQIINMWQEVGRAMYAPPIAGNITCISNITGLLLTRDGGNNTEDTETFRPEGGNMKDNWRSELYKYKVVEVKPLGVAPTN
ARERVVEREKE*

>HV1300620

MRVRGIQRNYPQWWIWSMLGFWMLMICNGVPVWKEAKTTLFCASDAKAYEKEVHNVWATHACVPTDPNPQEMVLKNVTEN
FNMWENDMVDQMHEDVISLWDQSLKPCVKLTPLCVTLNCINATNATDSKSNILEGMKNCSFNITTELRDKREKKNALFYK
LDIVQLGGNSNSSQYRLINCNTSVITQACPKVSFDPIPIHYCAPAGYAILKCNNKTFNGTGPCNNVSTVQCTHGIKPVVS
TQLLLNGSLAEGEIIIRSKNITDNSKTIIVHLNESVKIECTRPSNNTRTSIRIGPGQAFYATGQVIGNIREAHCNISESK
WNETLQRVSEKLKEYFPQKNITFQPSSGGDLEITTHSFNCGGEFFYCNTSSLFNRTYMATGTDMANSTETNIITIHCRIK
QIINMWQEVGRAMYAPPIAGNITCISNITGLLLTRDGGNSTEDTETFRPVGGNMKDNWSSELYKYKVVEVKPLGVAPTNA
RERVVEREKE*

>HV1300621

MRVRGIQRSYPQWWIWSMLGFWMLMICNGVPVWKEAKTTLFCASDAKAYEKEVHNVWATHACVPTDPNPQEMVLKNVTEN
FNMWENDMVDQMHEDVISLWDQSLKPCVKLTPLCVTLNCINATNATASDSSILDGMKNCSFNITTELRDKREKKNALFYK
LDIVQLGSNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNSKTIIVHLNESVKIECTRPSNNTRTSIRIGPGQAFYATGQVIGNIREAHCNISESKWN
ETLQRVSEKLKEYFPDKKITFQPSSGGDLEITTHSFNCGGEFFYCNTSSLFNRTYMANSTDMANSTETNSTQIITIHCRI
KQIINMWQEVGRAMYAPPIAGNITCISNITGLLLTRDGGNNTEDTETFRPVGGNMKDNWSSELYKYKVVEVKPLGVAPTN
ARERVVEREKE*

MRVRGIQRSYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCINATNATDSKSNILEGMKNCSFNITTELRDKREKKNALFYK
LDIVQLGGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNSKTIIVHLNESVKIECTRPSNNTRTSIRIGPGQAFYATGQVIGNIREAHCNISESKWN
ETLQRVSEKLKEYFPDKNITFQPSSGGDLEITTHSFNCGGEFFYCNTSSLFNRTYMANSTDMANSTETNSTQIITIHCRI
KQIINMWQEVGRAMYAPPIAGNITCISNITGLLLTRDGGNNTEDTETFRPVGGNMKDNWSSELYKYKVVEVKPLGVAPTK
ARERVVEREKE*

>HV1300623

MRVRGIQRNYPQWWIWSMLGFWMLMICNGVPVWKEAKTTLFCASDAKAYEKEVHNVWATHACVPTDPNPQEMVLKNVTEN
FNMWENDMVDQMHEDVISLWDQSLKPCVRLTPLCVTLNCINATNATASDSSILDGMKNCSFNITTELRDKREKKNALFYK
LDIVQLGGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNSKTIIVHLNESVKIECTRPSNNTRTSIRIGPGQAFYATGQVIGNIREAHCNISESKWN
ETLQRVSEKLKKYFPDKNITFQPSSGGDLEITTHSFNCGGEFFYCNTSSLFNRTYMATSTDLANSTETNIITIHCRIKQI
INMWQEVGRAMYAPPIAGNITCISNITGLLLTRDGGNNTEDTETFRPVGGNMKDNWSSELYKYKVVEVKPLGVAPTNARE
RVVKREKE*

>HV1300624

MRVMGRQRNYPQWWIWSMLGLWMLMICNGVPVWKEAKTTLFCASDAKGYEKEVHNVWATHACVPTDPNPQEMVLKNVTEN
FNMWENDMVDQMHEDVISLWDQSLKPCVKLTPLCVTLNCTDANATASNANATVSNTNATVSNDSSIIEEMKNCSFNITTE
LRDKIEKKYALFYKLDIVQLDGNSTHYRFINCNTSAITQACPKVSFDPIPIHYCAPAGYAILKCNNKTFNGTGPCNNVST
VQCTHGIKPVVSTQLLLNGSLAEGEIIIRSKNITDNGKTIIVHLNESVKIECTRPSNNTRTSIGIGPGQAFYATGQVIGD
IRKAHCNISESKWNETLQRVSKKLKEYFPGKNITFQPSSGGDPEVTTHSFNCGGEFFYCNTSSLFNRTYMTNSTDMANST
ETNRTITIHCRIKQIINMWQEVGRAMYAPPIAGNITCISNITGLLLTRDGGNSSTETETFRPEGGNMKDNWRSELYKYKV
VEVKPLGVAPTNARERVVEREKE*

>HV1300625

MRVRGIQRSYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCINATNATDSKSNILEGMKNCSFNITTELRDKREKKNALFYK
LDIVQLGSNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNSKTIIVHLNESVKIECTRPSNNTRTSIRIGPGQAFYATGQVIGNIREAHCNISESKWN
ETLQRVSEKLKEYFPDKNITFQPSSGGDLEITTHSFNCGGEFFYCNTSSLFNRTYMANSTDMANSTETNSTQIITIHCRI
KQIINMWQEVGRAMYAPPIAGNITCISNITGLLLTRDGGNNTEDTETFRPVGGNMKDNWSSELYKYKVVEVKPLGVAPTN
ARERVVEREKE*

>HV1300626

MRVRGIQRSYPQWWIWSMLGLWMLMICNGVPVWKEAKTTLFCASDAKAYEKEVHNVWATHACVPTDPNPQEMVLKNVTEN
FNMWENDMVDQMHEDVISLWDQSLKPCVRLTPLCVTLNCINATNATASDSSILDGMKNCSFNITTELRDKREKKNALFYK
LDIVQLGGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNSKTIIVHLNESVKIECTRPSNNTRTSIRIGPGQAFYATGQVIGNIREAHCNISESKWN
ETLQRVSEKLKKYFPDKNITFQPSSGGDLEITTHSFNCGGEFFYCNTSSLFNRTYMATSTDMANSTETNIITIHCRIKQI
INMWQEVGRAMYAPPIAGNITCISNITGLLLTRDGGNNTEDTETFRPVGGNMKDNWSSELYKYKVVEVKPLGVAPTNARE
RVVEREKE*

>HV1300627

MRVRGIQRSYPQWWIWSMLGFWMLMICNGMWVTVYYGVPVWKEAKTTLFCASDAKAYEKEVHNVWATHACVPTDPNPQEM
VLKNVTENFNMWENDMVDQMHEDVISLWDQSLKPCVKLTPLCVTLNCINATNATASDSSILDGMKNCSFNITTELRDKRE
KKNALFYKLDIVQLGSNSSQYRLINCNTSVITQACPKVSFDPIPIHYCAPAGYAILKCNNKTFNGTGPCNNVSTVQCTHG
IKPVVSTQLLLNGSLAEGEIIIRSKNITDNSKTIIVHLNESVKIECTRPSNNTRTSIRIGPGQAFYATGQVIGNIREAHC
NISESKWNETLQRVSEKLKEYFPDKNITFQPSSGGDLEITTHSFNCGGEFFYCNTSSLFNRTYMANSTDMANSTETNSTQ
IITIHCRIKQIINMWQEVGRAMYAPPIAGNITCISNITGLLLTRDGGNNTEDTETFRPVGGNMKDNWSSELYKYKVVEVK
PLGVAPTNARERVVEREKE*

MRVRGIQRSYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCINATNATASDSSILDGMKNCSFNITTELRDKREKKNALFYK
LDIVQLGGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNSKTIIVHLNESVKIECTRPSNNTRTSIRIGPGQAFYATGQVIGNIREAHCNISESKWN
ETLQRVSEKLKEYFPDKNITFQPSSGGDLEITTHSFNCGGEFFYCNTSSLFNRTYMANSTDMANSTETNSTQIITIHCRI
KQIINMWQEVGRAMYAPPIAGNITCISNITGLLLTRDGGNNTEDTETFRPVGGNMKDNWSSELYKYKVVEVKPLGVAPTN
ARERVVEREKE*

>HV1300629

MRVMGRQRNYPQWWIWSTLGLRMLMICNGVPVWKEAKTTLFCASDAKAYEKEVHNVWATHACVPTDPNPQEMVLKNVTEN
FNMWENDMVDQMHEDVISLWDQSLKPCVKLTPLCVTLNCTDANATASNANATVSNTNATVSNDSSIIEEMKNCSFNITTE
LRDKIEKKYALFYKLDIVQLDGNSTHYRFINCNTSAITQACPKVSFDPIPIHYCAPAGYAILKCNNKTFNGTGPCNNVST
VQCTHGIKPVVSTQLLLNGSLAEGEIIIRSENITDNAKTIIVHLNESVKIECTRPSNNTRTSIGIGPGQAFYATGQVIGD
IRKAHCNISESKWNETLQRVSKKLKEYFPGKNITFQPSSGGDPEVTTHSFNCGGEFFYCNTSSLFNRTYMTNSTDMANST
ETNRTITIHCRIKQIINMWQEVGRAMYAPPIAGNITCISNITGLLLTRDGGNNTDPEIFRPGGGNMKDNWRSELYKYKVV
EVKPLGVAPTNARERVVEREKE*

>HV1300749

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATANNSNIIEEMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTDMANSTETNSTRTITIHCRIKQIINMWQE
VGRAMYAPPIAGNITCISNITGLLLTRDGGKNNTETFRPGGGNMKDNWRSELYKYKVVEVKPLGVAPTNARERVVEREKE
*

>HV1300777

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNVRERV
VEREKE*

>HV1300778

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATNATASNSSIIEGMKNCSFNITTELRDKREKKNALFYK
LDIVQLDGNSSQYRLINCNTSVITQACPKVSFDPIPIHYCAPAGYAILKCNNKTFTGTGPCNNVSTVQCTHGIKPVVSTQ
LLLNGSLAEGEIIIRSENITNNDKTIIVHLNESVKIECTRPSNKTRTSIRIGPGQAFYATGQVIGDIREAYCNISESKWN
ETLQRVSKKLKEYFPHKNITFQPSSGGDLEITTHSFNCGGEFFYCNTSSLFNRTYMANSTDMANSTETNSTRNITIHCRI
KQIINMWQEVGRAMYAPPIAGNITCISNITGLLLTRDGGKNDTETFRPGGGNMKDNWRSELYKYKVVEVKPLGVAPTNAR
ERVVEREKE*

>HV1300779

MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTDATASNATASNATASNSSIIEEMKNCSFNITTELRDKREK
KNALFYKLDIVQLDGNSSQYRLINCNTSAITQACPKVSFDPIPIHYCAPAGYAILKCNNKTFNGTGPCNNVSTVQCTHGI
KPVVSTQLLLNGSLAEGEIIIRSENITDNGKTIIVHLNESVKIECTRPSNNTRTSIRIGPGQAFYATGQVIGDIREAHCN

Fig. 18 (cont.)

```
ISESKWNETLQRVSKKLKEYFPHKNITFQPSSGGDLEITTHSFNCGGEFFYCNTSSLFNRTYMANSTETNSTRIITIHCR
IKQIINMWQEVGRAMYAPPIAGNITCISNITGLLLTRDGGNNNTETFRPGGGNMKDNWRSELYKYKVVEVKPLGVAPTNA
RERVVEREKE*
```

Fig. 19B (CH505 Sequences of 13.seq.fasta file)

```
>TF
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKP
VVSTQLLLNGSLAEGEIIIRSENITNNVKTIIVHLNESVKIECTRPNNKTRTSIRIGPGQ
AFYATGQVIGDIREAYCNINESKWNETLQRVSKKLKEYFPHKNITFQPSSGGDLEITTHS
FNCGGEFFYCNTSSLFNRTYMANSTDMANSTETNSTRTITIHCRIKQIINMWQEVGRAMY
APPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWNSLWNWFNITN
WLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGW
EALKYLGSLVQYWGLELKRSAISLLDTLAIAVGEGTDRILEFVLGICRAIRNIPTRIRQG
FETALL
>M11
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKP
VVSTQLLLNGSLAEGEIIIRSENITDNGKTIIVHLNESVKIECTRPNNKTRTSIRIGPGQ
AFYATGQVIGDIREAYCNINESKWNETLQRVSKKLKEYFPHKNITFQPSSGGDLEITTHS
FNCGGEFFYCNTSSLFNRTYMANSTDMANSTETNSTRTITIHCRIKQIINMWQEVGRAMY
APPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWNSLWNWFNITN
WLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGW
EALKYLGSLVQYWGLELKRSAISLLDTLAIAVGEGTDRILEFVLGICRAIRNIPTRIRQG
FETALL
>w4.03
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKP
VVSTQLLLNGSLAEGEIIIRSENITNNVKTIIVHLNESVKIECTRPNNKTRTSIRIGPGQ
AFYATGQVIGDIREAYCNINESKWNETLQRVSKKLKEYFPHKNITFQPSSGGDLEITTHS
FNCGGEFFYCNTSSLFNRTYMANSTDMANSTETNSTRTITIHCRIKQIINMWQEVGRAMY
APPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWNSLWNWFNITN
WLGYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGW
EALKYLGSLVQYWGLELKRSAISLLDTLAIAVGEGTDRILEFVLGICRAIRNIPTRIRQG
FETALL
>w30.28
MRVMGIQRNYPQWWIWSMLGFWMLMICNGMWVTVYYGVPVWKEAKTTLFCASDAKAYEKE
```

Fig. 19B cont.
VHNVWATHACVPTDPNPQEMVLKNVTENFNMWKNDMVDQMHEDVISLWDQSLKPCVKMTP
LCVTLNCTNATAINSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKP
VVSTQLLLNGSLAEGEIIIRSENITNNDKTIIVHLNESVKIECTRPNNKTRTSIRIGPGQ
AFYATGQVIGDIREAHCNISESKWNETLQRVSKKLKEYFPHKNITFQPSSGGDLEITTHS
FNCGGEFFYCNTSSLFNRTYMANSTDMANSTETNSTRTITIRCRIKQIINMWQEVGRAMY
APPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNK
SYGDIWDNMTWMQWEREISNYTEIIYELLEESQNQQEKNEQDLLALDRWNSLWNWFNITN
WLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGW
EALKYLGSLVQYWGLELKRSAISLLDTLAIAVGEGTDRILEFVLGICRAIRNIPTRIRQG
FETALL
>w53.16
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLNCTNANATASNSSIIEGMNSSIIEGMKNCSFNITTELRDKREKKNALFYKLDIVQ
LDGNSSQYRLINCNTSVITQACPKVSFDPIPIHYCAPAGYAILKCNNKTFNGTGPCNNVS
TVQCTHGIKPVVSTQLLLNGSLAEGEIIIRSENITDNGKTIIVHLNESVKIECTRPSNNT
RTSIRIGPGQAFYATGQVIGDIREAHCNISESKWNETLQRVSEKLKEYFPHKNITFQPSS
GGDLEITTHSFNCGGEFFYCNTSSLFNRTYMATSTDMANSTETNSTRIITIRCRIKQIIN
MWQEVGRAMYAPPIAGNITCISNITGLLLTRDGGKNNTETFETFRPGGGNMKDNWRSELY
KYKVVEVKPLGVAPTNARRRVVEREKRAVGMGAVFLGFLGAAGSTMGAASITLTVQARQL
LSGIVQQQSNLLKAIEAQQHMLKLTVWGIKQLQARVLALERYLKDQQLLGMWGCSGKLIC
TTNVYWNSSWSNKTYGDIWDNMTWMQWEREISNYTEIIYELLEESQNQQEKNEQDLLALD
RWNSLWNWFNITNWLWYIKIFIMIVGGLIGLRIIFAVLSLVNRVRQGYSPLSLQTLIPSP
RGPDRPGGIEEEGGEQDRNRSTRLVSGFLALAWDDLRSLCLFIYHRLRDFILIAARAGEL
LGRSSLKGLRRGWEALKYLGSLVQYWGLELKRSAISLLDTLAIAVGEGTDRILEFVLGIC
RAIRNIPTRIRQGFETALL
>w53.31
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLNCTDATASNATASNATASNSSIIEGMKNCSFNITTELRDKREKKNALFYKLDIVQ
LDGNSSQYRLINCNTSVITQACPKVSFDPIPIHYCAPAGYAILKCNNKTFNGTGPCNNVS
TVQCTHGIKPVVSTQLLLNGSLAEGEIIIRSENITDNGKTIIVHLNESVKIECTRPSNNT
RTSIRIGPGQAFYATGQVIGDIREAHCNISESKWNETLQRVSKKLKEYFPHKNITFQPSS
GGDLEITTHSFNCGGEFFYCNTSSLFNRTYMANSTETNSTRIITIRCRIKQIINMWQEVG
RAMYAPPIAGNITCISNITGLLLTRDGGNNNTETFRPGGGNMKDNWRSELYKYKVVEVKP
LGVAPTNARRRVVEREKRAVGMGAVFLGFLGAAGSTMGAASITLTVQARQLLSGIVQQQS
NLLKAIGAQQHMLKLTVWGIKQLQARVLALERYLKDQQLLGMWGCSGKLICTTNVYWNSS
WSNKTYGDIWDNMTWMQWEREISNYTEMIYELLEESQNQQEKNEQDLLALDRWNSLWNWF
NITNWLWYIKIFIMIVGGLIGLRIIFAVLSLVNRVRQGYSPLSLQTLIPSPRGPDRPGGI
EEEGGEQDRKRSTRLVSGFLALVWDDLRSLCLFIYHRLRDFILIAARAGELLGRSSLKGL
RRGWEALKYLGSLVQYWGLELKRSAISLLDTLAIAVGEGTDRILEFALGICRAIRNIPTR
IRQGFETALL
>w78.33
MRVTGIQRNYPQWWIWSMLGLWMLMICNGMWVTVYYGVPVWKEAKTTLFCASDAKAYEKE
VHNVWATHACVPTDPNPQEMVLKNVTENFNMWKNDMADQMHEDVISLWDQSLKPCVKLTP
LCVTLNCIDANATASNATASNSSIIEGMKNCSFNITTELRDKIEKKNALFYKLDIVQLDG
NSSQYRLINCNTSVITQACPKVSFDPIPIHYCAPAGYAILKCNNKTFNGTGPCNNVSTVQ
CTHGIKPVVSTQLLLNGSLAEGEIIIRSENITNSAKTIIVHLNESVKIECTRPSNNTRTS
IRIGPGQAFYATGQVIGDIRKAHCNISESKWNETLQRVSKKLKEYFPHKNITFQPSSGGD
LEITTHSFNCGGEFFYCNTSSLFNRTYMANSTETNSTRTITLHCRIKQIINMWQEVGRAM
YAPPIAGNITCISNITGLLLTRDGGNNNTTETFRPGGGNMKDNWRSELYKYKVVEIKPLG

Fig. 19B cont.
VAPTNARRRVVEREKRAVGMGAVFLGFLGAAGSTMGAASITLTVQARQLLSGIVQQQSNL
LKAIEAQQHMLKLTVWGIKQLQARVLALERYLKDQQLLGMWGCSGKLICTTNVYWNSSWS
NKTYGDIWDNMTWMQWEREISDYTEIIYELLEESQNQQEKNEQDLLALDRWNSLWNWFNI
TNWLWYIKIFIMIVGGLIGLRIIFAVLSLVNRVRQGYSPLSLQTLTPSPRGPDRPGGIEE
EGGEQDRNRSTRLVSGFLALAWDDLRSLCLFIYHRLRDFILIAARAGELLGRSSLKGLRR
GWEALKYLGGLVQYWGLELKRSAISLLDTLAIAVGEGTDRILEFVLGICRAIRNIPTRIR
QGFETALL
>w78.15
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLSCTNATNATASNSSILEGMKNCSFNITTELRDKREKKNALFYKLDIVQLDGNSSQ
YRLINCNTSVITQACPKVSFDPIPIHYCAPAGYAILKCNNKTFNGTGPCNNVSTVQCTHG
IKPVVSTQLLLNGSLAEGEIIIRSKNITDNGKTIIVHLNESVKIECTRPSNNTRTSIRIG
PGQAFYATGQVIGDIREAHCNISESKWNETLQRVSEKLKEYFPHKNITFQPSSGGDLEIT
THSFNCGGEFFYCNTSSLFNRTYMATSTDMANSTETNSTRIITIRCRIKQIINMWQEVGR
AMYAPPIAGNITCISNITGLLLTRDGGKNDTDTFRPEGGNMKDNWRSELYKYKVVEVKPL
GVAPTNARRRVVEREKRAVGMGAVFLGFLGAAGSTMGAASITLTVQARQLLSGIVQQQSN
LLKAIEAQQHMLKLTVWGIKQLQARVLALERYLKDQQLLGMWGCSGKLICTTNVYWNSSW
SNKTYGDIWDNMTWMQWEREISNYTELIYELLEESQNQQEKNEQDLLALDRWNSLWNWFN
ITNWLWYIKIFIMIVGGLIGLRIIFAVLSLVNRVRQGYSPLSLQTLIPSPRGPDRPGGIE
EEGGEQDRNRSTRLVSGFLALAWDDLRSLCLFIYHRLRDFILIAARAGELLGRSSLKGLR
RGWEALKYLGNLVQYWGLELKRSAISLLDTLAIAVGEGTDRILEFVLGICRAIRNIPTRI
RQGFETALL
>w100.B6
MKVRGIQRNYPQWWIWSMLGLWMLMICNGMWVTVYYGVPVWKEAKTTLFCASDAKAYEKE
VHNVWATHACVPTDPNPQEMVLENVTENFNMWKNDMADQMHEDVISLWDQSLKPCVKLTP
LCVTLNCTDANATASNTNATASNINATASKSSIIEEMKNCSFNITTELRDKREKKYALFY
KLDIVQLDGNSSQYRLINCNTSVITQACPKVSFDPIPIHYCAPAGYAILKCNNKTFNGTG
PCNNVSTVQCTHGIKPVVSTQLLLNGSLAEGEIIIRSENITDNSKTIIVHLNESVKIECT
RPSNNTRTSIRIGPGQAFYATGQVIGDIREAHCNISESKWNETLQRVSKKLKEYFPDKNI
TFQPSSGGDPEITTHSFNCGGEFFYCNTSSLFNRTYMANSTETNSTRTITLHCRIKQIIN
MWQEVGRAMYAPPIAGNITCISNITGLLLTRDGGENTRDGGNNNTETFRPEGGNMKDNWR
SELYKYKVVEVKPLGVAPTKARRRVVEREKRAVGMGAVFLGFLGAAGSTMGAASITLTVQ
ARQLLSGIVQQQSNLLKAIEAQQHMLKLTVWGIKQLQARVLALERYLKDQQLLGMWGCSG
KLICTTNVYWNSSWSNKTYGDIWDNMTWMQWEREISNYTDIIYDLLEESQNQQEKNEQDL
LALDRWNSLWNWFNITKWLWYIKIFIMIVGGLIGLRIIFAVLSLVNRVRQGYSPLSLQTL
IPSPRGPDRPGGIEEEGGEQDRNRSTRLVSGFLALAWDDLRSLCLFIYHRLRDFILIAAR
AGELLGRSSLKGLRRGWEALKYLGGLVQYWGLELKRSAISLLDTLAIAVGEGTDRILEFV
LGICRAIRNIPTRIRQGFETALL
>703010505.TF_M24
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLNCTNATASNSSIIEGMKNCSFNITTELRDKREKKNALFYKLDIVQLDGNSSQYRL
INCNTSVIKQACPKVSFDPIPIHYCAPAGYAILKCNNKTFTGTGPCNNVSTVQCTHGIKP
VVSTQLLLNGSLAEGEIIIRSENITNNVKTIIVHLNESVKIECTRPNNKTRTSIRIGPGQ
AFYATGQVIGDIREAYCNINESKWNETLQRVSKKLKEYFPHKNITFQPSSGGDLEITTHH
FNCGGEFFYCNTSSLFNRTYMANSTDMANSTETNSTRTITIHCRIKQIINMWQEVGRAMY
APPIAGNITCISNITGLLLTRDGEKNNTETFRPGGGNMKDNWRSELYKYKVVEVKPLGVA
PTNARRRVVEREKRAVGMGAVFFGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWNSLWNWFNITN
WLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGW
EALKYLGSLVQYWGLELKRSAISLLDTLAIAVGEGTDRILEFVLGICRAIRNIPTRIRQG
FETALL

Fig. 19B cont.

>703010505.TF_M14
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKP
VVSTQLLLNGSLAEGEIIIRSENITNNVKTIIVHLNESVKIECTRPNNKTRTSIRIGPGQ
AFYATGQVIGDIREAYCNINESKWNETLQRVSKKLKEYFPHKNITFQPPSGGDLEITTHS
FNCGGEFFYCNTSSLFNRTYMANSTDMANSTETNSTRTITIHCRIKQIINMWQEVGRAMY
APPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWNSLWNWFNITN
WLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGW
EALKYLGSLVQYWGLELKRSAISLLDTLAIAVGEGTDRILEFVLGICRAIRNIPTRIRQG
FETALL
>w100.A4optional
MRVMGIQRSYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVRLTP
LCVTLNCINATNATASNSSILEGMKNCSFNITTELRDKREKKNALFYKLDIVQLDGNSSQ
YRLINCNTSVITQACPKVSFDPIPIHYCAPAGYAILKCNNKTFNGTGPCNNVSTVQCTHG
IKPVVSTQLLLNGSLAEGEIIIRSKNITDNGKTIIVHLNESVKIECTRPSNNTRTSIRIG
PGQAFYATGQVIGDIREAHCNISESKWNETLQRVSEKLKEYFPDKNITFQPSSGGDLEIT
THSFNCGGEFFYCNTSNLFNRTYMVNSTDMANSTETNSTRTITISCRIKQIINMWQEVGR
AMYAPPIAGNITCISNITGLLLTRDGGKNDTDTETFRPEGGNMKDNWRSELYKYKVVEVK
PLGVAPTNARRRVVEREKRAVGMGAVFLGFLGAAGSTMGAASITLTVQARQLLSGIVQQQ
SNLLKAIEAQQHMLKLTVWGIKQLQARVLALERYLKDQQLLGMWGCSGKLICTTNVYWNS
SWSNKTYGDIWDNMTWMQWEREISNYTDIIYELLEESQNQQEKNEQDLLALDRWNSLWNW
FNITNWLWYIKIFIMIVGGLIGLRIIFAVLSLVNRVRQGYSPLSLQTLIPSPRGPDRPGG
IEEEGGEQDRNRSTRLVSGFLALAWDDLRSLCLFIYHRLRDFILIAARAGELLGRSSLKG
LRRGWEALKYLGSLVQYWGLELKRSAISLLDTLAIAVGEGTDRILEFVLGICRAIRNIPT
RIRQGFETALL
>w78.7optional
MRVMGIQRNYTQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLNCTNVNATASNSSIIEGMNSSILEGMKNCSFNITTELRDKREKKNALFYKLDIVQ
LGGNSSQYRLINCNTSVITQACPKVSFDPIPIHYCAPAGYAILKCNNKTFNGTGPCNNVS
TVQCTHGIKPVVSTQLLLNGSLAEGEIIIRSKNITDNGKTIIVHLNESVKIECTRPSNNT
RTSIRIGPGQAFYATGQVIGDIREAHCNISESKWNETLQRVSEKLKEYFPDKNITFQPSS
GGDLEITTHSFNCGGEFFYCNTSSLFNRTYMANSTDMANSTETNSTRIITIRCRIKQIIN
MWQEVGRAMYAPPIAGNITCISNITGLLLTRDGGENNTETFETFRPGGGNMKDNWRSELY
KYKVVEVKPLGVAPTNARRRVVEREKRAVGMGAVFLGFLGAAGSTMGAASITLTVQARQL
LSGIVQQQSNLLKAIEAQQHMLKLTVWGIKQLQARVLALERYLKDQQLLGMWGCSGKLIC
TTNVYWNSSWSNKTYGDIWDNMTWMQWEREISNYTELIYELLEESQNQQEKNEQDLLALD
RWNSLWDWFNITNWLWYIKIFIMIVGGLIGLRIIFAVLSLVNRVRQGYSPLSLQTLIPSP
RGPDRPGGIEEEGGEQDRNRSTRLVSGFLALAWDDLRSLCLFIYHRLRDFILIAARAGEL
LGRSSLKGLRRGWEALKYLGSLVQYWGLELKRSAISLLDTLAIAVGEGTDRILEFVLGIC
RAIRNIPTRIRQGFETALL Fig. 19C (CH505 twelve envelopes alignment)

```
              STRLVSGPLALVWDDIRSLCLPINHRLRDFLIAARAGELLGRSSLKGLRKGWEALRYLGSLVQYWGLELKRSAISLLDTLAIAVGESTDRILEFVLGICRAIRNIPTRIRQGFETALL*
w4.03         ................................................................................................................
CR0505.TF.M11 ................................................................................................................
w14.32        ----A-----------------------------------------------------------------------------------K----------------------
w14.12        ----A-----------------------------------------------------------------------------------------------------------
w30.28        ----A-----------------------------------------------------------------------------------------------------------
w53.31        ----A-------------------------------------------------------------------------------------------A--------------
w53.16        ----A-----------------------------------------------------G----------------------------------------------------
w78.33        ----A-----------------------------------------------------M----------------------------------------------------
w78.15        ----A-----------------------------------------------------------------------------------------------------------
w78.7         ----A-----------------------------------------------------G----------------------------------------------------
w100.A4       ----A-----------------------------------------------------------------------------------------------------------
w100.B6       
              750
```

Fig. 20 (Amino acid sequences of CH505 gp145 constructs)

>HV1300631

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNVKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300632

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNVKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLGYIKIFIMIVGGLIGLRIIFAVLSLVNRVRQG*

>HV1300633

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNVKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIHCRIKQIINMWQEVGRAMYAPPIAGNITCISNITGLLLTRDGGKNNTETFRPGGGNMKDNWRSELYK
YKVVEVKPLGVAPTNVRRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300634

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNGKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRIITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQAKVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNNSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNAKTIIVHLNESVKIECTRPNNKTRTSIRIGPGQAFYATGQVIGDI
RKAYCNISESKWNETLQRVSKKLKEYFPHKNITFQPSSGGDLEITTHSFNCGGEFFYCNTSSLFNRTYMANSTDMANS
TETNSTRTITLHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300636

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKMTPLCVTLNCTNATAINSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNDKTIIVHLNESVKIECTRPNNKTRTSIRIGPGQAFYATGQVIGDI
REAHCNISESKWNETLQRVSKKLKEYFPHKNITFQPSSGGDLEITTHSFNCGGEFFYCNTSSLFNRTYMANSTDMANS
TETNSTRTITIRCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKSYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300637

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKMTPLCVTLNCTNATAINSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNDKTIIVHLNESVKIECTRPNNKTRTSIRIGPGQAFYATGQVIGDI
REAYCNISESKWNETLQRVSKKLKEYFPHKNITFQPSSGGDLEITTHSFNCGGEFFYCNTSSLFNRTYMANSTDMANS
TETNNTRPITIHCRIKQIINMWQEVGRAMYAPPIAGNITCISNITGLLLTRDGGKNNTETFRPGGGNMKDNWRSELYK
YKVVEVKPLGIAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300638

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTDATASNATASNATASNSSIIEGMKNCSF
NITTELRDKREKKNALFYKLDIVQLDGNSSQYRLINCNTSVITQACPKVSFDPIPIHYCAPAGYAILKCNNKTFNGTG
PCNNVSTVQCTHGIKPVVSTQLLLNGSLAEGEIIIRSENITDNGKTIIVHLNESVKIECTRPSNNTRTSIRIGPGQAF
YATGQVIGDIREAHCNISESKWNETLQRVSKKLKEYFPHKNITFQPSSGGDLEITTHSFNCGGEFFYCNTSSLFNRTY
MANSTETNSTRIITIRCRIKQIINMWQEVGRAMYAPPIAGNITCISNITGLLLTRDGGNNNTETFRPGGGNMKDNWRS
ELYKYKVVEVKPLGVAPTNARRRVVEREKRAVGMGAVFLGFLGAAGSTMGAASITLTVQARQLLSGIVQQQSNLLKAI
GAQQHMLKLTVWGIKQLQARVLALERYLKDQQLLGMWGCSGKLICTTNVYWNSSWSNKTYGDIWDNMTWMQWEREISN
YTEMIYELLEESQNQQEKNEQDLLALDRWNSLWNWFNITNWLWYIKIFIMIVGGLIGLRIIFAVLSLVNRVRQG*

>HV1300639

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLSCTNATNATASNSSILEGMKNCSFNITTELR
DKREKKNALFYKLDIVQLDGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNGKTIIVHLNESVKIECTRPSNNTRTSIRIGPGQAFYATGQVI
GDIREAHCNISESKWNETLQRVSEKLKEYFPHKNITFQPSSGGDLEITTHSFNCGGEFFYCNTSSLFNRTYMATSTDM
ANSTETNSTRIITIRCRIKQIINMWQEVGRAMYAPPIAGNITCISNITGLLLTRDGGKNDTDTFRPEGGNMKDNWRSE
LYKYKVVEVKPLGVAPTNARRRVVEREKRAVGMGAVFLGFLGAAGSTMGAASITLTVQARQLLSGIVQQQSNLLKAIE
AQQHMLKLTVWGIKQLQARVLALERYLKDQQLLGMWGCSGKLICTTNVYWNSSWSNKTYGDIWDNMTWMQWEREISNY
TELIYELLEESQNQQEKNEQDLLALDRWNSLWNWFNITNWLWYIKIFIMIVGGLIGLRIIFAVLSLVNRVRQG*

MRVMGRQRNYPQWWIWSMLGLWMLMICNGMWVTVYYGVPVWKEAKTTLFCASDAKAYEKEVHNVWATHACVPTDPNPQ
EMVLKNVTENFNMWENDMVDQMHEDVISLWDQSLKPCVKLTPLCVTLNCTDANATASNTNATASNINATASKNSIIEE
MKNCSFNITTELRDKREKKYALFYKLDIVQLDGNSSQYRLINCNTSVITQACPKVSFDPIPIHYCAPAGYAILKCNNK
TFNGTGPCNNVSTVQCTHGIKPVVSTQLLLNGSLAEGEIIIRSKNITDNGKTIIVHLNESVKIECTRPSNNTRTSIRI
GPGQAFYATGQVIGDIREAHCNISESKWNETLQRVSKKLKEYFPDKNITFQSSSGGDPEITTHSFNCGGEFFYCNTSS
LFNRTYMANSTDMANSTETNSTRIITIRCRIKQIINNMWQEVGRAMYAPPIAGNITCISNITGLLLTRDGGNSSTETFR
PEGGNMKDNWRSELYKYKVVEVKPLGVAPTNARRRVVEREKRAVGMGAVFLGFLGAAGSTMGAASITLTVQARQLLSG
IVQQQSNLLKAIEAQQHMLKLTVWGIKQLQARVLALERYLKDQQLLGMWGCSGKLICTTNVYWNSSWSNKTYDDIWDN
MTWMQWEREISNYTEMIYDLLEESQNQQEKNEQDLLALDRWNSLWNWFNITKWLWYIKIFIMIVGGLIGLRIIFAVLS
LVNRVRQG*

>HV1300641

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYVILKCNNKTFTGTGPCNNVSTVQC
THGIKPVVSTQLLLNGSLAEGEIIIRSENITNNVKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTIKIHCRIKQIINNMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300642

MRVMGIQRNYPQWWIWSMLGFWMLMICNGMWVTVYYGVPVWKEAKTTLFCASDAKAYEKEVHNVWATHACVPTDPNPQ
EMFLKNVTENFNMWKNDMVDQMHEDVISLWDQSLKPCVKLTPLCVTLNCTNATASNSSIIERMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNVKTIIVHLNESVKIECTRPNNKTRASIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIRCRIKQIINNMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300643

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNANASNNSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNGKTIIVHLNESVKIECTRPNNKTRTSIRIGPGQAFYATGQVIGDI
REAYCNISESKWNETLQRVSKKLKEYFPHKNITFQPSSGGDLEITTHSFNCGGEFFYCNTSSLFNRTYMANSTDMANS
TETNSTRIITIHCRIKQIINNMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300644

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNISIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNGKTIIVHLNESVKIECTRPNNKTRTSIRIGPGQAFYATGQVIGDI
REAYCNISESKWNETLQRVSKKLKEYFPHKNITFQPSSGGDLEITTHSFNCGGEFFYCNTSSLFNRTYMANSTDMANS
TETNSTRIITIHCRIKQIINNMWQEVGRAMYAPPIAGNITCISNITGLLLTRDGGKNNTETFRPGGGNMKDNWRSELYK

Fig. 20 cont.
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300645

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNAASNSSIIEGMKNCSFNITTELRDKRE
KKNALFYKLDIVQLDNSSQYRLINCNTSVITQACPKVSFDPIPIHYCAPAGYAILKCNNKTFTGTGPCNNVSTVQCT
HGIKPVVSTQLLLNGSLAEGEIIIRSENITNNAKTIIVHLNESVKIECTRPNNKTRTSIRIGPGQAFYATGQVIGDIR
KAYCNINESKWNETLQRVSKKLKEYFPHKNITFQPSSGGDLEITTHSFNCGGEFFYCNTSSLFNRTYMANSTDMANST
ETNNTRTITIHCRIKQIINMWQEVGRAMYAPPIAGNITCISNITGLLLTRDGGKNNTETFRPGGGNMKDNWRSELYKY
KVVVEVKPLGVAPTNARRRVVEREKRAVGMGAVFLGFLGAAGSTMGAASITLTVQARQLLSGIVQQQSNLLKAIEAQQH
MLKLTVWGIKQLQARVLALERYLKDQQLLGMWGCSGKLICTTNVYWNSSWSNKTYGDIWDNMTWMQWEREISNYTEII
YELLEESQNQQEKNEQDLLALDRWNSLWNWFNITNWLWYIKIFIMIVGGLIGLRIIFAVLSLVNRVRQG*

>HV1300646

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATNATASNSSIIEGMKNCSFNITTELR
DKREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNDKTIIVHLNESVKIECTRPSNKTRTSIRIGPGQAFYATGQVI
GDIREAYCNISESKWNETLQRVSKKLKEYFPHKNITFQPSSGGDLEITTHSFNCGGEFFYCNTSSLFNRTYMANSTDM
ANSTETNSTRNITIHCRIKQIINMWQEVGRAMYAPPIAGNITCISNITGLLLTRDGGKNDTETFRPGGGNMKDNWRSE
LYKYKVVEVKPLGVAPTNARRRVVEREKRAVGMGAVFLGFLGAAGSTMGAASITLTVQARQLLSGIVQQQSNLLKAIE
AQQHMLKLTVWGIKQLQARVLALERYLKDQQLLGMWGCSGKLICTTNVYWNSSWSNKTYGDIWDNMTWMQWEREISNY
TEIIYELLEESQNQQEKNEQDLLALDRWNSLWNWFNITNWLWYIKIFIMIVGGLIGLRIIFAVLSLVNRVRQG*

>HV1300648

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTDATASNATASNATASNSSIIEEMKNCSF
NITTELRDKREKKNALFYKLDIVQLDGNSSQYRLINCNTSAITQACPKVSFDPIPIHYCAPAGYAILKCNNKTFNGTG
PCNNVSTVQCTHGIKPVVSTQLLLNGSLAEGEIIIRSENITDNGKTIIVHLNESVKIECTRPSNNTRTSIRIGPGQAF
YATGQVIGDIREAHCNISESKWNETLQRVSKKLKEYFPHKNITFQPSSGGDLEITTHSFNCGGEFFYCNTSSLFNRTY
MANSTETNSTRIITIHCRIKQIINMWQEVGRAMYAPPIAGNITCISNITGLLLTRDGGNNNTETFRPGGGNMKDNWRS
ELYKYKVVEVKPLGVAPTNARRRVVEREKRAVGMGAVFLGFLGAAGSTMGAASITLTVQARQLLSGIVQQQSNLLKAI
EAQQHMLKLTVWGIKQLQARVLALERYLKDQQLLGMWGCSGKLICTTNVYWNSSWSNKTYGDIWDNMTWMQWEREISN
YTEIIYELLEESQNQQEKNEQDLLALDRWNSLWNWFNITNWLWYIKIFIMIVGGLIGLRIIFAVLSLVNRVRQG*

>HV1300649

MRVMGRQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTDATASNATASNSSIIEGMNSSIIEGMKN
CSFNITTELRDKREKKNALFYKLDIVQLDGNSSQYRLINCNTSVITQACPKVSFDPIPIHYCAPAGYAILKCNNKTFN
GTGPCNNVSTVQCTHGIKPVVSTQLLLNGSLAEGEIIIRSENITDNGKTIIVHLNESVKIECTRPSNNTRTSIRIGPG
QAFYATGQVIGDIREAHCNISESKWNETLQRVSEKLKEYFPHKNITFQPSSGGDLEITTHSFNCGGEFFYCNTSSLFN
RTYMATSTDMANSTETNSTRIITIRCRIKQIINMWQEVGRAMYAPPIAGNITCISNITGLLLTRDGGKNNTETFETFR
PGGGNMKDNWRSELYKYKVVEVKPLGVAPTNARRRVVEREKRAVGMGAVFLGFLGAAGSTMGAASITLTVQARQLLSG
IVQQQSNLLKAIEAQQHMLKLTVWGIKQLQARVLALERYLKDQQLLGMWGCSGKLICTTNVYWNSSWSNKTYGDIWDN
MTWMQWEREISDYTEIIYELLEESQNQQEKNEQDLLALDRWNSLWNWFNITNWLWYIKIFIMIVGGLIGLRIIFAVLS
LVNRVRQG*

>HV1300650

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVRLTPLCVTLNCINATNATASNNSILEGMKNCSFNIATELR

Fig. 20 cont.
DKREKKNALFYKLDIVQLDGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNGKTIIVHLNESVKIECTRPSNNTRTSIRIGPGQAFYATGQVI
GNIREAHCNISESKWNETLQRVSKKLKEYFPDKNITFQPSSGGDLEITTHSFSCGGEFFYCNTSSLFNRTYMATNTDM
ANSTETNSTRIITIRCRIRQIINMWQEVGRAMYAPPIAGNITCISNITGLLLTRDGGENNTETFETFRPGGGNMKDNW
RSELYKYKVVEVKPLGVAPTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWEREI
SNYTELIYELLEESQNQQEKNEQDLLALDRWNSLWNWFNITNWLWYIKIFIMIVGGLIGLRIIFAVLSLVNRVRQG*

>HV1300656

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITKNVKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300657

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNAKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300658

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSKNITDNSKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300659

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNSAKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300660

Fig. 20 cont.
MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSKNITDNGKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300661

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNGKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300662

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITDNGKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300663

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNDKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300664

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNSGKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNTAKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

\>HV1300666

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITKNVKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

\>HV1300667

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNVKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTITIRCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

\>HV1300668

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCITLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNGKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRIITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

\>HV1300669

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNVKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTYMANSTDMANS
TETNSTRTIKIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ

Fig. 20 cont.
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300670

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNTNATASNSSTIEGMKNCSFNIT
TELRDKREKKNALFYKLDIVQLDGNSSQYRLINCNTSVITQACPKVSFDPIPIHYCAPAGYAILKCNNKTFTGTGPCN
NVSTVQCTHGIKPVVSTQLLLNGSLAEGEIIIRSENITNNAKTIIVHLNESVKIECTRPNNKTRTSIRIGPGQAFYAT
GQVIGNIREAYCNISESKWNETLQRVSKKLKEYFPHKNITFQPSSGGDLEITTHSFNCGGEFFYCNTSSLFNRTYMAN
STDMANSTETNSTRIITIHCRIKQIINMWQEVGRAMYAPPIAGNITCISNITGLLLTRDGGKNNTETFRPGGGNMKDN
WRSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWIQWERE
ISNYTEIIYELLEESQNQQEKNEQDLLALDRWNSLWNWFNITNWLWYIKIFIMIVGGLIGLRIIFAVLSLANRVRQG*

>HV1300671

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATANNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNGKTIIVHLNESVKIECTRPNNKTRTSIRIGPGQAFYATGQVIGDI
REAYCNISESKWNETLQRVSKKLKEYFPHKNITFQPSSGGDLEITTHSFNCGGEFFYCNTSSLFNRTYMANSTDMANS
TETNSTRTITIRCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300672

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATANNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNAKTIIVHLNESVKIECTRPNNKTRTSIRIGPGQAFYATGQVIGNI
REAYCNISESKWNETLQRVSKKLKEYFPHKNITFQPSSGGDLEITTHSFNCGGEFFYCNTSSLFNRTYMANSTDMANS
TETNSTRTITLHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300673

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATTSNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNVKTIIVHLNESVKIECTRPNNKTRTSIRIGPGQAFYATGQVIRNI
REAYCNINESKWNETLQRVSKKLKEYFPHKNITFQPSSGGDLEITTHSFNCGGEFFYCNTSSLFNRTYMANSTDMANS
TETNSTRTIKIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300674

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATTSNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNVKTIIVHLNESVKIECTRPNNKTRTSIRIGPGQAFYATGQVIGDI

Fig. 20 cont.
REAYCNISESKWNETLQRVSKKLKEYFPHKNITFQPSSGGDLEITTHSFNCGGEFFYCNTSSLFNRTYMANSTDMANS
TETNNTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300675

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNATASNSSIIEGMKNCSFNITTE
LRDKREKKNALFYKLDIVQLDGNSSQYRLINCNTSVITQACPKVSFDPIPIHYCAPAGYAILKCNNKTFTGTGPCNNV
STVQCTHGIKPVVSTQLLLNGSLAEGEIIRSENITNNVKTIIVHLNESVKIECTRPNNKTRKSIRIGPGQAFYATGQ
VIGDIREAYCNISESKWNETLQRVSKKLKEYFPHKNITFQPSSGGDLEITTHSFNCGGEFFYCNTSSLFNRTYMANST
DMANSTETNSTRTITIRCRIKQIINMWQEVGRAMYAPPIAGNITCISNITGLLLTRDGGKNNTETFRPGGGNMKDNWR
SELYKYKVVEVKPLGVAPTNARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYGDIWDNMTWMQWEREIS
NYTEIIYELLEESQNQQEKNEQDLLALDRWNSLWNWFNITNWLWYIKIFIMIVGGLIGLRIIFAVLSLVNRVRQG*

>HV1300676

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATTSNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIRSENITNNVKTIIVHLNESVKIECTRPNNKTRTSIRIGPGQAFYATGQVIGDI
REAYCNISESKWNETLQRVSKKLKEYFPHKNITFQPSSGGDLEITTHSFNCGGEFFYCNTSSLFNRTYMANSTDMANS
TETNSTRTITIRCRIKQIINMWQEVGRAMYAPPIAGNITCISNITGLLLTRDGGKNNTETFRPGGGNMKDNWRSELYK
YKVVEVKPLGAAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300677

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATTSNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIRSENITNNAKTIIVHLNESVKIECTRPNNKTRTSIRIGPGQAFYATGQVIGDI
RKAYCNINESKWNETLQRVSKKLKEYFPHKNITFQPSSGGDLEITTHSFNCGGEFFYCNTSSLFNRTYMANSTDMANS
TETNNTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRRG*

>HV1300678

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATTSNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIRSENITNNAKTIIVHLNESVKIECTRPNNKTRTSIRIGPGQAFYATGQVIGDI
RKAYCNINESKWNETLQRVSKKLKEYFPHKNITFQPSSGGDLEITTHSFNCGGEFFYCNTSSLFNRTYMANSTDMANS
TETNSTRTITIRCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATANATASNSSIIEGMKNCSFNITTEL
RDKREKKNALFYKLDIVQLDGNSSQYRLINCNTSVITQACPKVSFDPIPIHYCAPAGYAILKCNNKTFTGTGPCNNVS
TVQCTHGIKPVVSTQLLLNGSLAEGEIIIRSENITNNGKTIIVQLNESVKIECTRPNNKTRTSIRIGPGQAFYATGQV
IGNIREAYCNISESKWNETLQRVSKKLKEYFPHKNITFQPSSGGDLEITTHSFNCGGEFFYCNTSSLFNRTYMANSTD
MANSTETNSTRIITIHCRIKQIINMWQEVGRAMYAPPIAGNITCISNITGLLLTRDGGKNNTDTETFRPGGGNMKDNW
RSELYKYKVVEVKPLGVAPTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWEREI
SNYTEIIYELLEESQNQQEKNEQDLLALDRWNSLWNWFNITNWLWYIKIFIMIVGGLIGLRIIFAVLSLVNRVRQG**

>HV1300680

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATTNATASNSSIIEGMKNCSFNITTEL
RDKREKKNALFYKLDIVQLDGNSSQYRLINCNTSVITQACPKVSFDPIPIHYCAPAGYAILKCNNKTFTGTGPCNNVS
TVQCTHGIKPVVSTQLLLNGSLAEGEIIIRSENITNNAKTIIVHLNESVKIECTRPSNKTRTSIRIGPGQAFYATGQV
IGDIREAYCNISESKWNETLQRVSKKLKEYFPHKNITFQPSSGGDLEITTHSFNCGGEFFYCNTSSLFNRTYMANSTD
MANSTETNSTRTITIRCRIKQIINMWQEVGRAMYAPPIAGNITCISNITGLLLTRDGGKNNTDTETFRPGGGNMKDNW
RSELYKYKVVEVKPLGVAPTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWEREI
SNYTEIIYELLEESQNQQEKNEQDLLALDRWNSLWNWFNITNWLWYIKVFIMIVGGLIGLRIIFAVLSLVNRVRQG*

>HV1300681

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATANATASNSSIIEGMKNCSFNITTEL
RDKREKKNALFYKLDIVQLDGNSSQYRLINCNTSVITQACPKVSFDPIPIHYCAPAGYAILKCNNKTFNGTGPCNNVS
TVQCTHGIKPVVSTQLLLNGSLAEGEIIIRSENITNNVKTIIVHLNESVKIECTRPNNKTRTSIRIGPGQAFYATGQV
IGDIREAHCNISESKWNKTLQRVSKKLKEYFPHKNITFQPSSGGDLEITTHSFNCGGEFFYCNTSSLFNRTYMANSTD
MANSTETNSTRTITIRCRIKQIINMWQEVGRAMYAPPIAGNITCISNITGLLLTRDGGKNNTDTETFRPGGGNMKDNW
RSELYKYKVVEVKPLGVAPTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWEREI
SNYTEIIYELLEESQNQQEKNEQDLLALDRWNSLWNWFNITNWLWYIKIFIMIVGGLIGLRIIFAVLSLVNRVRQG**

>HV1300682

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATTSNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNDKTIIVHLNESVKIECTRPNNNTRTSIRIGPGQAFYATGQVIGDI
REAYCNISESKWNETLQRVSKKLKEYFPHKNITFQPSSGGDLEITTHSFNCGGEFFYCNTSSLFNRTYMANSTDMANS
TETNSTRIITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300683

MRVMGIQRNYPQWWIWSMLGFWMLMICKGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNISIEEMKNCSFNITTELRDKRE
KKNALFYKLDIVQLDGNSSQYRLINCNTSVITQACPKVSFDPIPIHYCAPAGYAILKCNNKTFTGTGPCNNVSTVQCT
HGIKPVVSTQLLLNGSLAEGEIIIRSENITDNVKTIIVHLNESVKIECTRPNNKTRTSIRIGPGQAFYATGQVIGDIR
EAYCNISESKWNETLQRVSKKLKEYFPHKNITFQPSSGGDLEITTHSFNCGGEFFYCNTSSLFNRTYMANNSTETNST
RTITIRCRIKQIINMWQEVGRAMYAPPIAGNITCISNITGLLLTRDGGKNNTDTETFRPGGGNMKDNWRSELYKYKVV
EVKPLGVAPTNARRRVVEREKRAVGMGAVFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNKTYGDIWDNMTWMQWEREISNYTEIIYEL
LEESQNQQEKNEQDLLALDRWNSLWNWFNITNWLWYIKIFIMIVGGLIGLRIIFAVLSLVNRVRQG**

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNATASNSSIIEGMKNCSFNITTE
LRDKREKKNALFYKLDIVQLDGNSSQYRLINCNTSVITQACPKVSFDPIPIHYCAPAGYAILKCNNKTFTGTGPCNNV
STVQCTHGIKPVVSTQLLLNGSLAEGEIIIRSENITNNVKTIIVHLNESVKIECTRPNNKTRKSIRIGPGQAFYATGQ
VIGDIREAYCNINESKWNETLQRVSKKLKEYFPHKNITFQPSSGGDLEITTHSFNCGGEFFYCNTSSLFNRTYMANST
DMANSTETNSTRTITIRCRIKQIINMWQEVGRAMYAPPIAGNITCISNITGLLLTRDGGKNNTETFRPGGGNMKDNWR
SELYKYKVVEVKPLGVAPTNARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYGDIWDNMTWMQWEREIS
NYTEIIYELLEESQNQQEKNEQDLLALDRWNSLWNWFNITNWLWYIKIFIMIVGGLIGLRIIFAVLSLVNRVRQG*

>HV1300685

MRVMGIQRNYPQWWIWSMLGFWMLMICNGMWVTVYYGVPVWKEAKTTLFCASDAKAYEKEVHNVWATHACVPTDPNPQ
EMGLKNVTENFNMWKNDMVDQMHEDVISLWDQSLKPCVKLTPLCVTLNCTNATASNATASNSSIIEGMKNCSFNITTE
LRDKREKKNALFYKLDIVQLDGNSSQYRLINCNTSVITQACPKVSFDPIPIHYCAPAGYAILKCNNKTFTGTGPCNNV
STVQCTHGIKPVVSTQLLLNGSLAEGEIIIRSENITNNGKTIIVHLNESVKIECTRPNNKTRTSIRIGPGQAFYATGQ
VIGDIREAHCNISESKWNETLQRVSKKLKEYFPHQNITFQPSSGGDLEITTHSFNCGGEFFYCNTSSLFNRTYMANST
DMANSTETNSTRTITIRCRIKQIINMWQEVGRAMYAPPIAGNITCISNITGLLLTRDGGKNNTDTETFRPGGGNMKDN
WRSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWERE
ISNYTEIIYELLEESQNQQEKNEQDLLALDRWNSLWNWFNITNWLWYIKIFIMIVGGLIGLRIIFAVLSLVNRVRQG*
*GSRIR*PDPDLLCL

>HV1300686

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATNATASNSSIIEGMKNCSFNITTELR
DKREKKNALFYKLDIVQLDGNSSQYRLINCNTSVITQACPKVSFDPIPIHYCAPAGYAILKCNNKTFTGTGSCNNVST
VQCTHGIKPVVSTQLLLNGSLAEGEIIIRSENITDNGKTIIVHLNESVKIECTRPNNKTRTSIRIGPGQAFYATGQVI
GDIKEAYCNISESKWNETLQRVSKKLKEYFPHKNITFQPSSGGDLEITTHSFNCGGEFFYCNTSSLFNRTYMANSTDM
ANSTETNSTRNITIHCRIKQIINMWQEVGRAMYAPPIAGNITCISNITGLLLTRDGGKNNTDTETFRPGGGNMKDNWR
SELYKYKVVEVKPLGVAPTNARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYGDIWDNMTWMQWEREIS
NYTEIIYELLEESQNQQEKNEQDLLALDRWNSLWNWFNITNWLWYIKIFIMIVGGLIGLRIIFAVLSLVNRVRQG*

>HV1300687

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATANATASNSSIIEGMKNCSFNITTEL
RDKREKKNALFYKLDIVQLDGNSSQYRLINCNTSVITQACPKVSFDPIPIHYCAPAGYAILKCNNKTFTGTGPCNNVS
TVQCTHGIKPVVSTQLLLNGSLAEGEIIIRSENITNNAKTIIVHLNESVKIECTRPNNKTRTSIRIGPGQAFYATGQV
IGDIREAYCNISESKWNETLQRVSKKLKEYFPHKNITFQPSSGGDLEITTHSFNCGGEFFYCNTSSLFNRTYMANSTD
MANSTETNSTRIITIHCRIKQIINMWQEVGRAMYAPPIAGNITCISNITGLLLTRDGGKNNTETFRPGGGNMKDNWRS
ELYKYKVVEVKPLGVAPTNARRRVVEREKRAVGLGAVFLGFLGAAGSTMGAASITLTVQARQLLSGIVQQQSNLLKAI
EAQQHMLKLTVWGIKQLQARVLALERYLKDQQLLGMWGCSGKLICTTNVYWNSSWSNKTYGDIWDNMTWMQWEREISN
YTEIIYELLEESQNQQEKNEQDLLALDRWNSLWNWFNITNWLWYIKIFIMIVGGLIGLRIIFAVLSLVNRVRQG*

>HV1300688

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATTNATASNSSIIEGMKNCSFNITTEL
RDKREKKNALFYKLDIVQLDGNSSQYRLINCNTSVITQACPKVSFDPIPIHYCAPAGYAILKCNNKTFTGTGPCNNVS
TVQCTHGIKPVVSTQLLLNGSLAEGEIIIRSENITNNAKTIIVHLNESVKIECTRPNNKTRTSIRIGPGQAFYATGQV
IGDIREAYCNISESKWNETLQRVSKKLKEYFPHKNITFQPSSGGDLEITTHSFNCGGEFFYCNTSSLFNRTYMANSTD
MANSTETNSTRIITIHCRIKQIINMWQEVGRAMYAPPIAGNITCISNITGLLLTRDGGKNTRDGGKNNTETFRPGGGN

Fig. 20 cont.
MKDNWRSELYKYKVVEVKPLGVAPTNARRRVVEREKRAVGMGAVFLGFLGAAGSTMGAASITLTVQARQLLSGIVQQQ
SNLLKAIEAQQHMLKLTVWGIKQLQARVLALERYLKDQQLLGMWGCSGKLICTTNVYWNSSWSNKTYGDIWDNMTWMQ
WEREISNYTEIIYELLEESQNQQEKNEQDLLALDRWNSLWNWFNITNWLWYIKIFIMIVGGLIGLRIIFAVLSLVNRV
RQG*

>HV1300689

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATTNATASNSSIIEEMKNCSFNITTEL
RDKREKKNALFYKLDIVQLDGNSSQYRLINCNTSVITQACPKVSFDPIPIHYCAPAGYAILKCNNKTFTGTGPCNNVS
TVQCTHGIKPVVSTQLLLNGSLAEGEIIIRSENITNTAKTIIVHLNESVKIECTRPNNKTRTSIRIGPGQAFYATGQV
IGDIREAYCNISESKWNETLQRVSKKLKEYFPHKNITFQPSSGGDLEITTHSFNCGGEFFYCNTSSLFNRTYMANSTD
MANSTETNSTRTITIRCRIKQIINMWQEVGRAMYAPPIAGNITCISNITGLLLTRDGGENNTETFRPGGGNMKDNWRS
ELYKYKVVEVKPLGVAPTNARRRVVEREKRAVGMGAVFLGFLGAAGSTMGAASITLTVQARQLLSGIVQQQSNLLKAI
EAQQHMLKLTVWGIKQLQARVLALERYLKDQQLLGMWGCSGKLICTTNVYWNSSWSNKTYGDIWDNMTWMQWEREISN
YTEIIYELLEESQNQQEKNEQDLLALDRWNSLWNWFNITNWLWYIKIFIMIVGGLIGLRIIFAVLSLVNRVRQG*

>HV1300690

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNATASNSSIIEGMKNCSFNITTE
LRDKREKKNALFYKLDIVQLDGNSSQYRLINCNTSVITQACPKVSFDPIPIHYCAPAGYAILKCNNKTFTGTGPCNNV
STVQCTHGIKPVVSTQLLLNGSLAEGEIIIRSENITNNGKTIIVHLNESVKIECTRPSNKTRTSIRIGPGQAFYATGQ
VIGDIREAHCNISESKWNETLQRVSKKLKEYFPHKNITFQPSSGGDLEITTHSFNCGGEFFYCNTSSLFNRTYMANST
DMANSTETNSTRTITLHCRIKQIINMWQEVGRAMYAPPIAGNITCISNITGLLLTRDGGKNNTDTETFRPGGNMKDN
WRSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWERE
ISNYTEIIYELLEESQNQQEKNEQDLLALDRWNSLWNWFNITNWLWYIKIFIMIVGGLIGLRIIFAVLSLVNRVRQG*

>HV1300691

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATTNATASNSSIIEGMKNCSFNITTEL
RDKREKKNALFYKLDIVQLDGNSSQYRLINCNTSVITQACPKVSFDPIPIHYCAPAGYAILKCNNKTFTGTGPCNNVS
TVQCTHGIKPVVSTQLLLNGSLAEGEIIIRSENITNNAKTIIVHLNESVKIECTRPNNKTRTSIRIGPGQAFYATGQV
IGDIREAHCNISESKWNETLQRVSKKLKEYFPHKNITFQPSSGGDLEITTHSFNCGGEFFYCNTSSLFNRTYMANSTD
MANSTETNSTRTITIRCRIKQIINMWQEVGRAMYAPPIAGNITCISNITGLLLTRDGGKNNTDTETFRPGGGNMKDNW
RSELYKYKVVEVKPLGVAPTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWEREI
SNYTEIIYELLEESQNQQEKNEQDLLALDRWNNLWNWFNITNWLWYIKIFIMIVGGLIGLRIIFAVLSLVNRVRQG*

>HV1300692

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATASNATASNSSIIEGMKNCSFNITTE
LRDKREKKNALFYKLDIVQLDGNSSQYRLINCNTSVITQACPKVSFDPIPIHYCAPAGYAILKCNNKTFTGTGPCNNV
STVQCTHGIKPVVSTQLLLNGSLAEGEIIIRSENITNNVKTIIVHLNESVKIECTRPNNKTRTSIRIGPGQAFYATGQ
VIGNIREAYCNISESKWNETLQRVSKKLKEYFPHKNITFQPSSGGDLEITTHSFNCGGEFFYCNTSSLFNRTYMANST
DMANSTETNSTRIITIHCRIKQIINMWQEVGRAMYAPPIAGNITCISNITGLLLTRDGGKNNTDTETFRPGGGNMKDN
WRSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWERE
ISNYTEIIYELLEESQNQQEKNEQDLLALDRWNSLWNWFNITNWLWYIKIFIMIVGGLIGLRIIFAVLSLVNRVRQG*

>HV1300693

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATANATASNSSIIEGMKNCSFNITTEL

Fig. 20 cont.
RDKREKKNALFYKLDIVQLDGNSSQYRLINCNTSVITQACPKVSFDPIPIHYCAPAGYAILKCNNKTFNGTGPCNNVS
TVQCTHGIKPVVSTQLLLNGSLAEGEIIIRSENITNNVKTIIVHLNESVKIECTRPNNKTRTSIRIGPGQAFYATGQV
IGDIREAYCNISESKWNETLQRVSKKLKEYFPHKNITFQPSSGGDLEITTHSFNCGGEFFYCNTSSLFNRTYMANSTD
MANSTETNSTRTIKIHCRIKQIINMWQEVGRAMYAPPIAGNITCISNITGLLLTRDGGKNNTDTETFRPGGGNMKDNW
RSELYKYKVVEVKPLGVAPTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWEREI
SNYTEIIYELLEESQNQQEKNEQDLLALDRWNSLWNWLNITNWLWYIKIFIMIVGGLIGLRIIFAVLSLVNRVRQG*

>HV1300694

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATNATASNSSILEGMKNCSFNITTELR
DKREKKNALFYKLDIVQLDGNSSQYRLINCNTSVITQACPKVSFDPIPIHYCAPAGYAILKCNNKTFNGTGPCNNVST
VQCTHGIKPVVSTQLLLNGSLAEGEIIIRSENITDNGKTIIVHLNESVKIECTRPSNNTRTSIRIGPGQAFYATGQVI
GDIREAHCNISESKWNETLQRVSKKLKEYFPHKNITFQPSSGGDLEITTHSFNCGGEFFYCNTSSLFNRTYMANSTET
NSTRTITLHCRIKQIINMWQEVGRAMYAPPIAGNITCISNITGLLLTRDGGKNNTETFETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300695

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATNATASNSSILEGMKNCSFNITTELR
DKREKKNALFYKLDIVQLDGNSSQYRLINCNTSVITQACPKVSFDPIPIHYCAPAGYAILKCNNKTFNGTGPCNNVST
VQCTHGIKPVVSTQLLLNGSLAEGEIIIRSENITDNGKTIIVHLNESVKIECTRPSNNTRTSIRIGPGQAFYATGQVI
GDIREAHCNISESKWNETLQRVSKKLKEYFPHKNITFQPSSGGDLEITTHSFNCGGEFFYCNTSSLFNRTYMANSTET
NSTRTITIRCRIKQIINMWQEVGRAMYAPPIAGNITCISNITGLLLTRDGGENNTETFETFRPGGGNMKDNWRSELYK
YKVVEVKPLGVAPTNARRRAVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTEI
IYELLEESQNQQEKNEQDLLALDRWNSLWNWFNITNWLWYIKIFIMIVGGLIGLRIIFAVLSLVNRVRQG*

>HV1300696

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNANATASNSSIIEGMNSSIIEGMKNCSF
NITTELRDKREKKNALFYKLDIVQLDGNSSQYRLINCNTSVITQACPKVSFDPIPIHYCAPAGYAILKCNNKTFNGTG
PCNNVSTVQCTHGIKPVVSTQLLLNGSLAEGEIIIRSENITDNGKTIIVHLNESVKIECTRPSNNTRTSIRIGPGQAF
YATGQVIGDIREAHCNISESKWNETLQRVSEKLKEYFPHKNITFQPSSGGDLEITTHSFNCGGEFFYCNTSSLFNRTY
MATSTDMANSTETNSTRIITIRCRIKQIINMWQEVGRAMYAPPIAGNITCISNITGLLLTRDGGKNNTETFETFRPGG
GNMKDNWRSELYKYKVVEVKPLGVAPTNARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMTW
MQWEREISNYTEIIYELLEESQNQQEKNEQDLLALDRWNSLWNWFNITNWLWYIKIFIMIVGGLIGLRIIFAVLSLVN
RVRQG*

>HV1300697

MRVMGIQRNYPQWWIWSMLGLWMLMICNGMWVTVYYGVPVWKEAKTTLFCASDAKAYEKEVHNVWATHACVPTDPNPQ
EMVLKNVTENFNMWENDMVDQMHEDVISLWDQSLKPCVKLTPLCVTLNCTDATASNATASNSSIIEGMKNCSF
NITTELRDKREKKNALFYKLDIVQLDGNSSQYRLINCNTSVITQACPKVSFDPIPIHYCAPAGYAILKCNNKTFNGTG
PCNNVSTVQCTHGIKPVVSTQLLLNGSLAEGEIIIRSENITDNGKTIIVHLNESVKIECTRPSNNTRTSIRIGPGQAF
YATGQVIGDIREAHCNISENKWNETLQRVSKKLKEYFPHKNITFQPSSGGDLEITTHSFNCGGEFFYCNTSSLFNRTY
MANSTDMANSTETNSTRTITIRCRIKQIINMWQEVGRAMYAPPIAGNITCISNITGLLLTRDGGKNNTETFETFRPGG
GNMKDNWRSELYKYKVVEVKPLGVAPTNARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMTW
MQWEREISNYTEIIYELLEESQNQQEKNEQDLLALDRWNSLWNWFNITNWLWYIKIFIMIVGGLIGLRIIFAVLSLVN
RVRQG*

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTDATASNATAINSSIIEGMKNCSFNITTE
LRDKREKKNALFYKLDIVQLDGNSSQYRLINCNTSVITQACPKVSFDPIPIHYCAPAGYAILKCNNKTFNGTGPCNNV
STVQCTHGIKPVVSTQLLLNGSLAEGEIIIRSENITNNAKTIIVHLNESVKIECTRPSNNTRTSIRIGPGQAFYATGQ
VIGDIREAHCNISESKWNETLQRVSKKLKEYFPHKNITFQPSSGGDLEITTHSFNCGGEFFYCNTSSLFNRTYMANST
ETNSTRIITIRCRIKQIINMWQEVGRAMYAPPIAGNITCISNITGLLLTRDGGKNNTETFETFRPEGGNMKDNWRSEL
YKYKVVEVKPLGVAPTNARRRVVEREKRAVGMGAVFLGFLGAAGSTMGAASITLTVQARQLLSGIVQQQSNLLKAIEA
QQHMLKLTVWGIKQLQARVLALERYLKDQQLLGMWGCSGKLICTTNVYWNSSWSNKTYGDIWDNMTWMQWEREISNYT
EIIYELLEESQNQQEKNEQDLLALDRWNSLWNWFNITNWLWYIKIFIMIVGGLIGLRIIFAVLSLVNRVRQG*

\>HV1300699

MRVMGIQRNYPQWWIWSMLGLWMLMICNGMWVTVYYGVPVWKEAKTTLFCASDAKAYEKEVHNVWATHACVPTDPNPQ
EMVLKNVTENFNMWKNDMADQMHEDVISLWDQSLKPCVKLTPLCVTLNCTDATASNATASNATASNSSINSSIIEEMK
NCSFNITTELRDKREKKNALFYKLDIVQLDGNSSQYRLINCNTSAITQACPKVSFDPIPIHYCAPAGYAILKCNNKTF
NGTGPCNNVSTVQCTHGIKPVVSTQLLLNGSLAEGEIIIRSENITDNGKTIIVHLNESVKIECTRPSNNTRTSIRIGP
GQAFYATGQVIGDIREAHCNISESKWNETLQRVSKKLKEYFPHKNITFQPSSGGDLEVTTHSFNCGGEFFYCNTSSLF
NRTDMANSTETNSTRIITIRCRIKQIVNMWQEVGRAMYAPPIAGNITCISNITGLLLTRDGGENNGGKNNTETFRPGG
GNMKDNWRSELYKYKVVEVKPLGVAPTNARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMTW
MQWEREISNYTEIIYELLEESQNQQEKNEQDLLALDRWNSLWNWFNITKWLWYIKIFIMIVGGLIGLRIIFAVLSLVN
RVRQG*

\>HV1300700

MRVMGIQRNYTQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNVNATASNSSIIEGMNSSILEGMKNCSF
NITTELRDKREKKNALFYKLDIVQLGGNSSQYRLINCNTSVITQACPKVSFDPIPIHYCAPAGYAILKCNNKTFNGTG
PCNNVSTVQCTHGIKPVVSTQLLLNGSLAEGEIIIRSKNITDNGKTIIVHLNESVKIECTRPSNNTRTSIRIGPGQAF
YATGQVIGDIREAHCNISESKWNETLQRVSEKLKEYFPDKNITFQPSSGGDLEITTHSFNCGGEFFYCNTSSLFNRTY
MANSTDMANSTETNSTRIITIRCRIKQIINMWQEVGRAMYAPPIAGNITCISNITGLLLTRDGGENNTETFETFRPGG
GNMKDNWRSELYKYKVVEVKPLGVAPTNARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMTW
MQWEREISNYTELIYELLEESQNQQEKNEQDLLALDRWNSLWDWFNITNWLWYIKIFIMIVGGLIGLRIIFAVLSLVN
RVRQG*

\>HV1300701

MRVMGIQRNYPQWWIWSMLGLWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTDATASNATASNATASNATASNSSIIEG
MKNCSFNITTELRDKREKKNALFYKLDIVQLDGNSSQYRLINCNTSVITQACPKVSFDPIPIHYCAPAGYAILKCNNK
TFNGTGPCNNVSTVQCTHGIKPVVSTQLLLNGSLAEGEIIIRSKNITDNGKTIIVHLNESVKIECTRPSNNTRTSIRI
GPGQAFYATGQVIGDIREAHCNISESKWNETLQRVSKKLKEYFPQKNITFQPSSGGDLEITTHSFNCGGEFFYCNTSS
LFNRTYMANSTDMANSTETNRTITIRCRIKQIINMWQEVGRAMYAPPIAGNITCISNITGLLLTRDGGKNNTETFETF
RPGGGNMKDNWRSELYKYKVVEVKPLGVAPTNARRRVVEREKRAVGMGAVFLGFLGAAGSTMGAASITLTVQARQLLS
GIVQQQSNLLKAIEAQQHMLKLTVWGIKQLQARVLALERYLKDQQLLGMWGCSGKLICTTNVYWNSSWSNKTYGDIWD
NMTWMQWEREISNYTEMIYELLEESQNQQEKNEQDLLALDRWNSLWNWFNITKWLWYIKIFIMIVGGLICLRIIFAVL
SLVNRVRQG*

\>HV1300702

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCIDATASNATAINISIIEEMKNCSFNITTE
LRDKREKKNALFYKLDIVQLDGNSSQHRLINCNTSVITQACPKVSFDPIPIHYCAPAGYAILKCNNKTFNGTGPCNNV
STVQCTHGIKPVVSTQLLLNGSLAEGEIIIRSKNITDNGKTIIVHLNESVKIECTRPSNNTRTSIRIGPGQAFYATGQ

Fig. 20 cont.
VIGNIREAHCNISESKWNETLQRVSEKLKEYFPHKNITFQPSSGGDLEITTHSFNCGGEFFYCNTSSLFNRTYMATST
DMANSTETNSTRIITIRCRIKQIINMWQEVGRAMYAPPIAGNITCISNITGLLLTRDGGKNDTDTETFRPEGGNMKDN
WRSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWERE
ISNYTDIIYELLEESQNQQEKNEQDLLALDRWNSLWNWFNITNWLWYIKIFIMIVGGLIGLRIIFAVLSLVNRVRQG*

>HV1300703

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLDCINATNATASNSSILEGMKNCSFNITTELR
DKREKKNALFYKLDIVQLGGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNGKTIIVHLNESVKIECTRPSNNTRTSIRIGPGQAFYATGQVI
GDIREAHCNISESKWNETLQRVSKKLKEYFPDKNITFQPSSGGDLEITTHSFNCGGEFFYCNTSSLFNRTYMVNSTDM
ANSTETNSTRTITIRCRIKQIINMWQEVGRAMYAPPIAGNITCISNITGLLLTRDGGENNTETFETFRPGGGNMKDNW
RSELYKYKVVEVKPLGVAPTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWEREI
SNYTELIYELLEESQNQQEKNEQDLLALDRWNSLWNWFNITNWLWYIKIFIMIVGGLIGLRIIFAVLSLVNRVRQG*

>HV1300704

MRVMGRQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLTPCVKLTPLCVTLNCTDATASNATASNATASNATASNSSIEGMK
NCSFNITTELRDKREKKNALFYKLDIVQLDGNSSQYRLINCNTSVITQACPKVSFDPIPIHYCAPAGYAILKCNNKTF
NGTGPCNNVSTVQCTHGIKPVVSTQLLLNGSLAEGEIIIRSKNITDNGKTIIVHLNESVKIECTRPSNNTRTSIRIGP
GQAFYATGQVIGDIREAHCNISESKWNETLQRVSEKLKEYFPNKNITFQPSSGGDLEITTHSFNCGGEFFYCNTSSLF
NRTYMANSTDMANSTETNSTRIITIRCRIKQIINMWQEVGRAMYAPPIAGNITCISNITGLLLTRDGGKNNTETFETF
RPGGGNMKDNWRSELYKYKVVEVKPLGVAPTNARRRVVEREKRAVGMGAVFLGFLGAAGSTMGAASITLTVQARQLLS
GIVQQQSNLLKAIEAQQHMLKLTVWGIKQLQARVLALERYLKDQQLLGMWGCSGKLICTTNVYWNSSWSNKTYGDIWD
NMTWMQWEREISNYTEMIYELLEESQNQQEKNEQDLLALDRWNSLWNWFNITKWLWYIKIFIMIVGGLIGLRIIFAVL
SLVNRVRQG**EFGNQDPDPDLLCL

>HV1300705

MRVTGIQRNYPQWWIWSMLGLWMLMICNGMWVTVYYGVPVWKEAKTTLFCASDAKAYEKEVHNVWATHACVPTDPNPQ
EMVLKNVTENFNMWKNDMADQMHEDVISLWDQSLKPCVKLTPLCVTLNCIDANATASNATASNSSIIEGMKNCSFNIT
TELRDKIEKKNALFYKLDIVQLDGNSSQYRLINCNTSVITQACPKVSFDPIPIHYCAPAGYAILKCNNKTFNGTGPCN
NVSTVQCTHGIKPVVSTQLLLNGSLAEGEIIIRSENITNSAKTIIVHLNESVKIECTRPSNNTRTSIRIGPGQAFYAT
GQVIGDIRKAHCNISESKWNETLQRVSKKLKEYFPHKNITFQPSSGGDLEITTHSFNCGGEFFYCNTSSLFNRTYMAN
STETNSTRTITLHCRIKQIINMWQEVGRAMYAPPIAGNITCISNITGLLLTRDGGNNNTTETFRPGGGNMKDNWRSEL
YKYKVVEIKPLGVAPTNARRRVVEREKRAVGMGAVFLGFLGAAGSTMGAASITLTVQARQLLSGIVQQQSNLLKAIEA
QQHMLKLTVWGIKQLQARVLALERYLKDQQLLGMWGCSGKLICTTNVYWNSSWSNKTYGDIWDNMTWMQWEREISDYT
EIIYELLEESQNQQEKNEQDLLALDRWNSLWNWFNITNWLWYIKIFIMIVGGLIGLRIIFAVLSLVNRVRQG*

>HV1300706

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCIDATASNATAINISIIEEMKNCSFNITTE
LRDKREKKNALFYKLDIVQLDGNSSQHRLINCNTSVITQACPKVSFDPIPIHYCAPAGYAILKCNNKTFNGTGPCNNV
STVQCTHGIKPVVSTQLLLNGSLAEGEIIIRSKNITDNGKTIIVHLNESVKIECTRPSNNTRTSIRIGPGQAFYATGQ
VIGNIREAHCNISKSKWNETLQRVSEKLKEYFPHKNITFQPSSGGDLEITTHSFNCGGEFFYCNTSSLFNRTYMATST
DMANSTETNSTRIITIRCRIKQIINMWQEVGRAMYAPPIAGNITCISNITGLLLTRDGGKNDTDTETFRPEGGNMKDN
WRSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWERE
ISNYTDIIYELLEESQNQQEKNEQDLLALDRWNSLWNWFNITNWLWYIKIFIMIVGGLIGLRIIFAVLSLVNRVRQG*

MRVMGIQKNCPQWWIWSMLGLWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTDANATASNSSIIKGMNSSMIEEMKNCSF
NITTELRDKREKKNALFYKLDIVQLDGNSSQYRLINCNTSVITQACPKVSFDPIPIHYCAPAGYAILKCNNKTFNGTG
PCNNVSTVQCTHGIKPVVSTQLLLNGSLAEGEIIIRSKNITDNGKTIIVHLNESVKIECTRPSNNTRTSIRIGPGQAF
YATGQVIGDIREAHCNISESKWNETLQRVSKKLKEYFPQKDITFQPSSGGDLEITTHSFNCGGEFFYCNTSSLFNRTY
MATSTDMANSTETNSTRIITIRCRIKQIINMWQEVGRAMYAPPIAGNITCISNITGLLLTRDGGENDTDTETFRPEGG
NMKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTWM
QWEREISNYTDIIYELLEESQNQQEKNEQDLLALDRWNSLWNWFNITNWLWYIKIFIMIVGGLIGLRIIFAVLSLVNR
VRQG*

>HV1300708

MRVMGIQRSYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVRLTPLCVTLNCINATNATASNSSILEGMKNCSFNITTELR
DKREKKNALFYKLDIVQLDGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNGKTIIVHLNESVKIECTRPSNNTRTSIRIGPGQAFYATGQVI
GDIREAHCNISESKWNETLQRVSEKLKEYFPDKNITFQPSSGGDLEITTHSFNCGGEFFYCNTSNLFNRTYMVNSTDM
ANSTETNSTRTITISCRIKQIINMWQEVGRAMYAPPIAGNITCISNITGLLLTRDGGKNDTDTETFRPEGGNMKDNWR
SELYKYKVVEVKPLGVAPTNARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYGDIWDNMTWMQWEREIS
NYTDIIYELLEESQNQQEKNEQDLLALDRWNSLWNWFNITNWLWYIKIFIMIVGGLIGLRIIFAVLSLVNRVRQG*

>HV1300709

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCINATNATASNSSILEGMKNCSFNITTELR
DKREKKNALFYKLDIVQLDGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNGKTIIVHLNESVKIECTRPSNNTRTSIRIGPGQAFYATGQVI
GNIREAHCNISESKWNETLQRVSEKLKEYFPQKNITFQPSSGGDLEITTHSFNCGGEFFYCNTSSLFNRTYMATSTDM
ANSTETNSTRIITIRCRIKQIINMWQEVGRAMYAPPIAGNITCISNITGLLLTRDGGNDTDTETFRPEGGNMKDNWRS
ELYKYKVVEVKPLGVAPTNARRRVVEREKRAVGMGAVFLGFLGAAGSTMGAASITLTVQARQLLSGIVQQQSNLLKAI
EAQQHMLKLTVWGIKQLQARVLALERYLKDQQLLGMWGCSGKLICTTNVYWNSSWSNKTYGDIWDNMTWMQWEREISN
YTDIIYELLEESQNQQEKNEQDLLALDRWNSLWNWFNITNWLWYIKIFIMIVGGLIGLRIIFAVLSLVNRVRQG*

>HV1300710

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTDATNATASNSSILGGMKNCSFNITTELR
DKREKKNALFYKLDIVQLDGNSSQYRLINCNTSAITQACPKVSFDPIPIHYCAPAGYAILKCNNKTFNGTGPCNNVST
VQCTHGIKPVVSTQLLLNGSLAEGEIIIRSKNITDNGKTIIVHLNESVKIECTRPSNNTRTSIRIGPGQAFYATGQVI
GDIREAHCNISESKWNETLQRVSEKLKEYFPDKNITFQPSSGGDLEITTHSFNCGGEFFYCNTSSLFNRTYMANSTDM
ANSTETNSTRIITIRCRIKQIINMWQEVGRAMYAPPIAGNITCISNITGLLLTRDGGKNDTDTETFRPEGGNMKDNWR
SELYKYKVVEVKPLGVAPTNARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYGDIWDNMTWMQWEREIS
NYTELIYELLEESQNQQEKNEQDLLALDRWNSLWNWFNITNWLWYIKIFIMIVGGLIGLRIIFAVLSLVNRVRQG*

>HV1300711

MRVRGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVRLTPLCVTLNCINATNATASNSSILEGMKNCSFNITTELR
DKREKKNALFYKLDIVQLDGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNGKTIIVHLNESVKIECTRPSNNTRTSIRIGPGQAFYATGQVI
GDIREAHCNISESKWNETLQRVSEKLKEYFPDKNITFQPSSGGDLEITTHSFNCGGEFFYCNTSSLFNRTYMANSTDM
ANSTETNSTRIITLHCRIKQIINMWQEVGRAMYAPPIAGNITCISNITGLLLTRDGGNDTDTETFRPEGGNMKDNWRS
ELYKYKVVEVKPLGVAPTNARRRVVEREKRAVGMGAVFLGFLGAAGSTMGAASITLTVQARQLLSGIVQQQSNLLKAI

Fig. 20 cont.

EAQQHMLKLTVWGIKQLQARVLALERYLKDQQLLGMWGCSGKLICTTNVYWNSSWSNKTYGDIWDNMTWMQWEREISN
YTDIIYELLEESQNQQEKNEQDLLALDRWNSLWNWFNITNWLWYIKIFIMIVGGLIGLRIIFAVLSLVNRVRQG*

>HV1300712

MRVMGIQRNYPQWWIWSMLGLWMLMICNGMWVTVYYGVPVWKEAKTTLFCASDAKAYEKEAHNVWATHACVPTDPNPQ
EMVLKNVTENFNMWKNDMADQMHEDVISLWDQSLKPCVKLTPLCVTLNCTDANATASNANATASNTNATVSNSSIIEE
MKNCSFNITTELRDKREKKYALFYKLDIVQLDGNSSQYRLINCNTSVITQACPKVSFDPIPIHYCAPAGYAILKCNNK
TFNGTGPCNNVSTVQCTHGIKPVVSTQLLLNGSLAEGEIIIRSENITNSAKTIIVHLNESVKIECTRPSNNTRTSIRI
GPGQAFYATGQVIGDIRKAHCNISESKWNETLQRVSKKLKEYFPHKNITFQPSSGGDPEITTHSFNCGGEFFYCNTSS
LFNRTYMANSTETNSTRTITLHCRIKQIINMWQEVGRAMYAPPIAGNITCISNITGLLLTRDGGENTRDGGNNNTETF
RPGGGNMKDNWRSELYKYKVVEVKPLGVAPTNARRRVVEREKRAVGMGAVFLGFLGAAGSTMGAASITLTVQARQLLS
GIVQQQSNLLKAIEAQQHMLKLTVWGIKQLQARVLALERYLKDQQLLGMWGCSGKLICTTNVYWNSSWSNKTYGDIWD
NMTWMQWEREISNYTDIIYDLLEESQNQQEKNEQDLLALDRWNSLWNWFNITKWLWYIKIFIMIVGGLIGLRIIFAVL
SLVNRVRQG*

>HV1300713

MRVMGIQRNYPQWWIWSMLGLWMLMICNGMWVTVYYGVPVWKKAKTTLFCASDAKAYEKEVHSVWATHACVPTDPNPQ
EMVLKNVTENFNMWKNDMVDQMHEDVISLWDQSLKPCVKLTPLCVTLNCTDANATASNSSIIKGMNSSMIEEMKNCSF
NITTELRDKREKKNALFYKLDIVQLDGNSSQYRLINCNTSVITQACPKVSFDPIPIHYCAPAGYAILKCNNKTFNGTG
PCNNVSTVQCTHGIKPVVSTQLLLNGSLAEGEIIIRSENITNSAKTIIVHLNESVKIECTRPSNNTRTSIRIGPGQAF
YATGQVIGDIRKAHCNISESKWNETLQRVSKKLKEYFPDRNITFQPSSGGDPEITTHSFNCGGKFFYCNTSSLFNRTY
MANSTDMANSTETNSTRIITIRCRIKQIINMWQEVGRAMYAPPIAGNITCISNITGLLLTRDGGNNNTETFRPVGGNM
KDNWRSKLYKYKVVEVKPLGVAPTKARRRMVEREKRAVGMGAVFLGFLGAAGSTMGAASITLTVQARQLLSGIVQQQS
NLLKAIEAQQHMLKLTVWGIKQLQARVLALERYLKDQQLLGMWGCSGKLICTTNVYWNSSWSNKTYGDIWDNMTWMQW
EREISNYTEIIYDLLEESQNQQEKNEQDLLALDRWNSLWNWFNITKWLWYIKIFIMIVGGLIGLKIIFAVLSLVNRVR
QG*

>HV1300714

MKVRGIQRNYPQWWIWSMLGLWMLMICNGMWVTVYYGVPVWKEAKTTLFCASDAKAYEKEVHNVWATHACVPTDPNPQ
EMVLENVTENFNMWKNDMADQMHEDVISLWDQSLKPCVKLTPLCVTLNCTDANATASNTNATASNINATASKSSIIEE
MKNCSFNITTELRDKREKKYALFYKLDIVQLDGNSSQYRLINCNTSVITQACPKVSFDPIPIHYCAPAGYAILKCNNK
TFNGTGPCNNVSTVQCTHGIKPVVSTQLLLNGSLAEGEIIIRSENITDNSKTIIVHLNESVKIECTRPSNNTRTSIRI
GPGQAFYATGQVIGDIREAHCNISESKWNETLQRVSKKLKEYFPDKNITFQPSSGGDPEITTHSFNCGGEFFYCNTSS
LFNRTYMANSTETNSTRTITLHCRIKQIINMWQEVGRAMYAPPIAGNITCISNITGLLLTRDGGENTRDGGNNNTETF
RPEGGNMKDNWRSELYKYKVVEVKPLGVAPTKARRRVVEREKRAVGMGAVFLGFLGAAGSTMGAASITLTVQARQLLS
GIVQQQSNLLKAIEAQQHMLKLTVWGIKQLQARVLALERYLKDQQLLGMWGCSGKLICTTNVYWNSSWSNKTYGDIWD
NMTWMQWEREISNYTDIIYDLLEESQNQQEKNEQDLLALDRWNSLWNWFNITKWLWYIKIFIMIVGGLIGLRIIFAVL
SLVNRVRQG*

>HV1300715

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMADQMHEDVISLWDQSLKPCVKLTPLCVTLNCTDANATASNINATASKSSIIEEMKNCSFN
ITTELRDKREKKYALFYKLDIVQLDGNSSQYRLINCNTSVITQACPKVSFDPIPIHYCAPAGYAILKCNNKTFNGTGP
CNNVSTVQCTHGIKPVVSTQLLLNGSLAEGEIIIRSENITDNSKTIIVHLNESVKIECTRPSNNTRTSIRIGPGQAFY
ATGQVIGDIREAHCNISESKWNETLQRVSKKLKEYFPDKNITFQPSSGGDPEITTHSFNCGGEFFYCNTSSLFNRTYM
ANSTETNSTRTITLHCRIKQIINMWQEVGRAMYAPPIAGNITCISNITGLLLTRDGGENTRDGGNNNTETFRPEGGNM
KDNWRSELYKYKVVEVKPLGVAPTKARRRVVEREKRAVGMGAVFLGFLGAAGSTMGAASITLTVQARQLLSGIVQQQS
NLLKAIEAQQHMLKLTVWGIKQLQARVLALERYLKDQQLLGMWGCSGKLICTTNVYWNSSWSNKTYGDIWDNMTWMQW
EREISNYTDIIYELLEESQNQQEKNEQDLLALDRWNSLWNWFNITNWLWYIKIFIMIVGGLIGLRIIFAVLSLVNRVR
QG*

>HV1300716

Fig. 20 cont.
MRVMGIQRNYPQWWIWSMLGLWMLMTCNGMWVTVYYGVPVWKEAKTTLFCASDAKAYEKEVHNVWATHACVPTDPNPQ
EMVLKNVTENFNMWENDMVDQMHEDVISLWDQSLKPCVKLTPLCVTLNCTDANATASNTNATASNINATASKSSIIEE
MKNCSFNITTELRDKREKKYALFYKLDIVQLDGNSSQYRLINCNTSVITQACPKVSFDPIPIHYCAPAGYAILKCNNK
TFNGTGPCNNVSTVQCTHGIKPVVSTQLLLNGSLAEGEIIIRSKNITDNGKTIIVHLNESVKIECTRPSNNTRTSIRI
GPGQAFYATGQVIGDIREAHCNISESKWNETLQRVSKKLKEYFPDKNITFQSSSGGDPEITTHSFNCGGEFFYCNTSS
LFNRTYMANSTDMANSTETNSTRIITIHCRIKQIINMWQEVGRAMYAPPIAGNITCISNITGLLLTRDGGENNGGKNN
TETFRPGGGNMKDNWRSELYKYKVVEVKPLGVAPTKARRRVVEREKRAVGMGAVFLGFLGAAGSTMGAASITLTVQAR
QLLSGIVQQQSNLLKAIEAQQHMLKLTVWGIKQLQARVLALERYLKDQQLLGMWGCSGKLICTTNVYWNSSWSNKTYG
DIWDNMTWMQWEREISNYTDIIYDLLEESQNQQEKNEQDLLALDRWNSLWNWFNITKWLWYIKIFIMIVGGLIGLRII
FAVLSLVNRVRQG*

>HV1300717

MRVRGIQRNYPQWWIWSMLGLWMLMICNGMWVTVYYGVPVWKEAKTTLFCASDAKAYEKEAHNVWATHACVPTDPNPQ
EMVLKNVTENFNMWENDMVDQMHEDVISLWDQSLKPCVKLTPLCVTLNCTDANATASNTNATVSNIKATVSNSSIIEE
MKNCSFNITTELRDKIEKKYALFYKLDIVQLDGNSTQYRFINCNTSAITQACPKVSFDPIPIHYCAPAGYAILKCNNK
TFNGTGPCNNVSTVQCTHGIKPVVSTQLLLNGSLAEGEIIIRSENITDNGKTIIVHLNESVKIECTRPGNNTRTSIRI
GPGQAFYATGQVIGDIRQAHCNISESKWNETLQRVSEKLKEYFPNKTITFQPSSGGDPEITTHSFNCGGEFFYCNTSS
LFNRTYMANSTETNSTRTITLHCRIKQIINMWQEVGRAMYAPPIAGNITCISNITGLLLTRDGGNTTDIETFRPGGGN
MKDNWRSELYKYKVVEVKPLGVAPTKARRRVVEREKRAVGMGAVFLGFLGAAGSTMGAASITLTVQARQLLSGIVQQQ
SNLLKAIEAQQHMLKLTVWGIKQLQARVLALERYLKDQQLLGMWGCSGKLICTTNVYWNSSWSNKTYDDIWDNMTWMQ
WEREISNYTEIIYDLLEESQNQQEKNEQDLLALDRWNSLWNWFNITKWLWYIKIFIMIVGGLIGLRIIFAVLSLVNRV
RQG*

>HV1300718

MRVRGIQRNYPQWWIWSMLGLWMLMICNGMWVTVYYGVPVWKEAKTTLFCASDAKAYEKEAHNVWATHACVPTDPNPQ
EMVLKNVTENFNMWENDMVDQMHEDVISLWDQSLKPCVKLTPLCVTLNCTDANATASNANATASNTNATVSNDSSIIE
EMKNCSFNITTELRDKIEKKYALFYKLDIVQLDGNSTQYRFINCNTSAITQACPKVSFDPIPIHYCAPAGYAILKCNN
KTFNGTGPCNNVSTVQCTHGIKPVVSTQLLLNGSLAEGEIIIRSKNITDNGNTIIVHLNESVKIECTRPSNNTRTSIR
IGPGQAFYATGQVIGDIRQAHCNISESKWNETLQRVSEKLKEYFPDKNITFQPSSGGDPEITTHSFNCGGEFFYCNTS
SLFNRTYMANSTETNSTRTITLHCRIKQIINMWQEVGRAMYAPPIAGNITCISNITGLLLTRDGGNSSKETETFRPGG
GNMKDNWRSELYKYKVVEVKPLGVAPTNARRRVVEREKRAVGMGAVFLGFLGAAGSTMGAASITLTVQARQLLSGIVQ
QQSNLLKAIEAQQHMLRLTVWGIKQLQARVLALERYLKDQQLLGMWGCSGKLICTTNVYWNSSWSNKTYSDIWDNMTW
MQWEGEISNYTEIIYNLLEESQNQQEKNEQDLLALDRWNSLWNWFNITKWLWYIKIFIMIVGGLIGLRIIFAVLSLVN
RVRQG*

>HV1300719

MRVRGIQRSYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCINATNATDSNSNILEGMKNCSFNITTELR
DKREKKNALFYKLDIVQLGGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNSKTIIVHLNESVKIECTRPSNNTRTSIRIGPGQAFYATGQVI
GNIREAHCNISESKWNETLQRVSEKLKKYFPDKNITFRPSSGGDLEITTHSFNCGGEFFYCNTSSLFNRTYMATSTDM
ANSTETNSTRIITIHCRIKQIINMWQEVGRAMYAPPIAGNITCISNITGLLLTRDGGNNTEDTETFRPEGGNMKDNWR
SELYKYKVVEVKPLGVAPTNARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYDDIWDNMTWMQWEREIS
NYTNIIYELLEESQNQQEKNEQDLLALDRWNSLWNWFNITNWLWYIKIFIMIVGGLIGLRIIFAVLSLVNRVRQG*

>HV1300720

MRVMGTQRNYPQWWIWSMLGLWMLMICNGMWVTVYYGVPVWKEAKTTLFCASDAKAYEKEVHNVWATHACVPTDPNPQ
EMVLKNVTENFNMWKNDMADQMHEDVISLWDQSLKPCVKLTPLCVTLYCINATANATVSNSSIIEEMKNCSFNITTEL
RDKREKKNALFYKLDIVQLDGNSSQYRLINCNTSAITQACPKVSFDPIPIHYCAPAGYAILKCNNKTFNGTGPCNNVS
TVQCTHGIKPVVSTQLLLNGSLAEGEIIIRSENITNSAKTIIVHLNESVKIECTRPSNNTRTSIRIGPGQAFYATGQV
IGDIRQAHCNISESKWNETLQRVSEKLKEYFPNKTITFQPSSGGDPEITTHSFNCGGEFFYCNTSSLFNRTYMANSTD
MANSTETNSTRTITLHCRIKQIINMWQEVGRAMYAPPIAGNITCISNITGLLLTRDGGNSSKETETFRPGGGNMKDNW

Fig. 20 cont.
RSELYKYKVVEVKPLGVAPTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWEREI
SNYTDLIYDLLEESQNQQEKNEQDLLALDRWNSLWNWFNITKWLWYIKIFIMIVGGLIGLRIIFAVLSLVNRVRQG*

>HV1300721

MRVRGIQRSYPQWWIWSMLGFWMLMICNGMWVTVYYGVPVWKEAKTTLFCASDAKAYEKEVHNVWATHACVPTDPNPQ
EMVLKNVTENFNMWENDMVDQMHEDVISLWDQSLKPCVKLTPLCVTLNCINATNATDSNSNILEGMKNCSFNITTELR
DKREKKNALFYKLDIVQLGGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNSKTIIVHLNESVKIECTRPSNNTRTSIRIGPGQAFYATGQVI
GNIREAHCNISESKWNETLQRVSEKLKKYFPDKNITFRPSSGGDLEITTHSFNCGGEFFYCNTSSLFNRTYMATSTDM
ANSTETNSTRIITIHCRIKQIINMWQEVGRAMYAPPIAGNITCISNITGLLLTRDGGNNTEDTETFRPEGGNMKDNWR
SELYKYKVVEVKPLGVAPTNARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYDDIWDNMTWMQWEREIS
NYTNIIYELLEESQNQQEKNEQDLLALDRWNSLWNWFNITNWLWYIKIFIMIVGGLIGLRIIFAVLSLVNRVRQG*

>HV1300722

MRVMGIQRSYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLSCINATNATDSNNSILEGMKNCSFNITTELR
DKREKKNALFYKLDIVQLYGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNGKTIIVHLNESVKIECTRPSNNTRTSIRIGPGQAFYATGQVI
GNIREAHCNISESKWNETLQRVSEKLKEYFPDKNITFQPSSGGDLEITTHSFNCGGEFFYCNTSSLFNRTYMATSTDM
ANSTETNSTRIITIHCRIKQIINMWQEVGRAMYAPPIAGNITCISNITGLLLTRDGGNNTEDTETFRPEGGNMKDNWR
SELYKYKVVEVKPLGVAPTNARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYSDIWDNMTWMQWEREIS
NYTDMIYELLEESQNQQEKNEQDLLALDRWNSLWNWFNITNWLWYIKIFIMIVGGLIGLRIIFAVLSLVNRVRQG*

>HV1300723

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCINATNATDSNSNILEGMKNCSFNITTELR
DKREKKNALFYKLDIVQLGGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNSKTIIVHLNESVKIECTRPSNNTRTSIRIGPGQAFYATGQVI
GNIREAHCNISESKWTETLQRVSEKLKKYFPDKNITFRPSSGGDLEITTHSFNCGGEFFYCNTSSLFNRTYMATSTDM
ANSTEINSTRIITIHCRIKQIINMWQEVGRAMYAPPIAGNITCISNITGLLLTRDGGNNTEDTETFRPEGGNMKDNWR
SELYKYKVVEVKPLGVAPTNARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYDDIWDNMTWMQWEREIS
NYTNIIYELLEESQNQQEKNEQDLLALDRWNSLWNWFNITNWLWYIKIFIMIVGGLIGLRIIFAVLSLVNRVRQG*

>HV1300724

MRVMGRQRNYPQWWIWSMLGLWMLMICNGMWVTVYYGVPVWKEAKTTLFCASDAKAYEKEVHNVWATHACVPTDPNPQ
EMVLKNVTENFNMWKNDMVDQMHEDVISLWDQSLTPCVKLTPLCVTLNCTDANDTASNSSIIKGMNNSIVGEMKNCSF
NITTELRDKREKKNALFYKLDIVQLDGNSSEYRLINCNTSVITQACPKVSFDPIPIHYCAPAGYAILKCNNKTFNGTG
PCNNVSTVQCTHGIKPVVSTQLLLNGSLAEGEIIIRSENITDNAKTIIVHLNESVKIECTRPSNNTRTSIRIGPGQAF
YATGQVIGDIRKAHCNISESKWNETLQRVSKKLKEYFPDKNITFQPSSGGDPEITTHSFNCGGEFFYCNTSSLFNRTY
MANSTDMANSAETNSTRTITLHCRIKQIINMWQEVGRAMYAPPIAGNITCISNITGLLLTRDGGNSSTETETFRPGGG
NMKDNWRSELYKYKVVEVKPLGVAPTNARRRVVEREKRAVGMGAVFLGFLGAAGSTMGAASITLTVQARQLLSGIVQQ
QSNLLKAIEAQQHMLRLTVWGIKQLQARVLALERYLKDQQLLGMWGCSGKLICTTNVYWNSSWSNKTYDDIWDNMTWM
QWEGEISNYTNIIYDLLEESQNQQEKNEQDLLALDRWNSLWNWFNITNWLWYIKIFIMIVGGLIGLRIIFAVLSLVNR
VRQG*

>HV1300725

MRVRGIQRSYPQWWIWSMLGFWMLMICNGMWVTVYYGVPVWREAKTTLFCASDAKAYEKEVHNVWATHACVPTDPNPQ
EMVLKNVTENFNMWENDMVDQMHEDVISLWDQSLKPCVKLTPLCVTLNCINATNATDSNSNILEGMKNCSFNITTELR

Fig. 20 cont.

```
DKREKKNALFYKLDIVQLGGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNSKTIIVHLNESVKIECTRPSNNTRTSIRIGPGQAFYATGQVI
GNIREAHCNISESKWNETLQRVSKKLKKYFPDKNITFRPSSGGDLEITTHSFNCGGEFFYCNTSSLFNRTYMATSIDM
ANSTETNSTRIITIHCRIKQIINMWQEVGRAMYAPPIAGNITCISNITGLLLTRDGGNNTEDTETFRPEGGNMKDNWR
SELYKYKVVEVKPLGVAPTNARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYDDIWDNMTWMQWEREIS
NYTNIIYELLEESQNQQEKNEQDLLALDRWNSLWNWFNITNWLWYIKIFIMIVGGLIGLRIIFAVLSLVNKVRQG*

>HV1300726

MRVRGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCINATNATASNSNILEGMKNCSFNITTELR
DKREKKNALFYKLDIVQLGGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNSKTIIVHLNESVKIECTRPSNNTRTSIRIGPGQAFYATGQVI
GNIREAHCNISESKWNETLQRVSEKLKEYFPDKNITFQPSSGGDLEITTHSFNCGGEFFYCNTSSLFNRTYMANSTDM
ANSTETNSTRIITLHCRIKQIINMWQEVGRAMYAPPIAGNITCISNITGLLLTRDGGNNTEDTETFRPEGGNMKDNWR
SELYKYKVVEVKPLGVAPTNARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYSDIWDNMTWMQWEREIS
NYTDMIYELLEESQNQQEKNEQDLLALDRWNSLWNWFNITNWLWYIKIFIMIVGGLIGLRIIFAVLSLVNRVRQG*

>HV1300727

MRVRGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCINATNATDSNSNILEGMKNCSFNITTELR
DKREKKNALFYKLDIVQLGGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNSKTIIVHLNESVKIECTRPSNNTRTSIRIGPGQAFYATGQVI
GNIREAHCNISESKWNETLQRVSEKLKKYFPDKNITFRPSSGGDLEITTHSFNCGGEFFYCNTSSLFNRTYMATSTDM
ANSTETNSTRIITIHCRIKQIINMWQEVGRAMYAPPIAGNITCISNITGLLLTRDGGNNTEDTETFRPEGGNMKDNWR
SELYKYKVVEVKPLGVAPTNARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYDDIWDNMTWMQWEREIS
NYTNIIYELLEESQNQQEKNEQDLLALDRWNSLWNWFNITNWLWYIKIFIMIVGGLIGLRIIFAVLSLVNRVRQG*

>HV1300728

MRVRGIQRSYPQWWIWSMLGFWMLMICNGMWVTVYYGVPVWKEAKTTLFCASDAKAYEKEVHNVWATHACVPTDPNPQ
EMVLKNVTENFNMWENDMVDQMHEDVISLWDQSLKPCVKLTPLCVTLNCINATNATDSNSNILEGMKNCSFNITTELR
DKREKKNALFYKLDIVQLGGNSSQYRLINCNTSVITQACPKVSFDPIPIHYCAPAGYAILKCNNKAFNGTGPCNNVST
VQCTHGIKPVVSTQLLLNGSLAEGEIIIRSKNITDNSKTIIVHLNESVKIECTRPSNNTRTSIRIGPGQAFYATGQVI
GNIREAHCNISESKWNETLQRVSEKLKKYFPDKNITFRPSSGGDLEITTHSFNCGGEFFYCNTSSLFNRTYMATSTDM
ANSTETNSTRIITIHCRIKQIINMWQEVGRAMYAPPIAGNITCISNITGLLLTRDGGNNTEDTETFRPEGGNMKDNWR
SELYKYKVVEVKPLGVAPTNARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYDDIWDNMTWMQWEREIS
NYTNIIYELLEESQNQQEKNEQDLLALDRWNSLWNWFNITNWLWYIKIFIMIVGGLIGLRIIFAVLSLVNRVRQG*

>HV1300729

MRVRGIQRNYPQWWIWSMLGFWMLMICNGMWVTVYYGVPVWKEAKTTLFCASDAKAYEKEVHNVWATHACVPTDPNPQ
EMVLKNVTENFNMWENDMVDQMHEDVISLWDQSLKPCVKLTPLCVTLNCINATNATDSKSNILEGMKNCSFNITTELR
DKREKKNALFYKLDIVQLGGNSNSSQYRLINCNTSVITQACPKVSFDPIPIHYCAPAGYAILKCNNKTFNGTGPCNNV
STVQCTHGIKPVVSTQLLLNGSLAEGEIIIRSKNITDNSKTIIVHLNESVKIECTRPSNNTRTSIRIGPGQAFYATGQ
VIGNIREAHCNISESKWNETLQRVSEKLKEYFPQKNITFQPSSGGDLEITTHSFNCGGEFFYCNTSSLFNRTYMATGT
DMANSTETNIITIHCRIKQIINMWQEVGRAMYAPPIAGNITCISNITGLLLTRDGGNSTEDTETFRPVGGNMKDNWSS
ELYKYKVVEVKPLGVAPTNARRRVVEREKRAVGMGAVFLGFLGAAGSTMGAASITLTVQARQLLSGIVQQQSNLLKAI
EAQQHMLKLTVWGIKQLQARVLALERYLKDQQLLGMWGCSGKLICTTNVYWNSSWSNKTYDDIWDNMTWMQWEREISN
YTNIIYELLEESQNQQEKNEQDLLALDRWNSLWNWFNITNWLWYIKIFIMIVGGLIGLRIIFAVLSLVNRVRQG*

MRVRGIQRSYPQWWIWSMLGFWMLMICNGMWVTVYYGVPVWKEAKTTLFCASDAKAYEKEVHNVWATHACVPTDPNPQ
EMVLKNVTENFNMWENDMVDQMHEDVISLWDQSLKPCVKLTPLCVTLNCINATNATASDSSILDGMKNCSFNITTELR
DKREKKNALFYKLDIVQLGSNSSQYRLINCNTSVITQACPKVSFDPIPIHYCAPAGYAILKCNNKTFNGTGPCNNVST
VQCTHGIKPVVSTQLLLNGSLAEGEIIIRSKNITDNSKTIIVHLNESVKIECTRPSNNTRTSIRIGPGQAFYATGQVI
GNIREAHCNISESKWNETLQRVSEKLKEYFPDKKITFQPSSGGDLEITTHSFNCGGEFFYCNTSSLFNRTYMANSTDM
ANSTETNSTQIITIHCRIKQIINMWQEVGRAMYAPPIAGNITCISNITGLLLTRDGGNNTEDTETFRPVGGNMKDNWS
SELYKYKVVEVKPLGVAPTNARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYDDIWDNMTWMQWEREIS
NYTEIIYELLEESQNQQEKNEQDLLALDRWNSLWNWFNITNWLWYIKIFIMIVGGLIGLRIIFAVLSLVNRVRQG*

>HV1300731

MRVRGIQRSYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCINATNATDSKSNILEGMKNCSFNITTELR
DKREKKNALFYKLDIVQLGGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNSKTIIVHLNESVKIECTRPSNNTRTSIRIGPGQAFYATGQVI
GNIREAHCNISESKWNETLQRVSEKLKEYFPDKNITFQPSSGGDLEITTHSFNCGGEFFYCNTSSLFNRTYMANSTDM
ANSTETNSTQIITIHCRIKQIINMWQEVGRAMYAPPIAGNITCISNITGLLLTRDGGNNTEDTETFRPVGGNMKDNWS
SELYKYKVVEVKPLGVAPTKARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYDDIWDNMTWMQWEREIS
NYTNIIYELLEESQNQQEKNEQDLLALDRWNSLWNWFNITNWLWYIKIFIMIVGGLIGLRIIFAVLSLVNRVRQG*

>HV1300732

MRVRGIQRNYPQWWIWSMLGFWMLMICNGMWVTVYYGVPVWKEAKTTLFCASDAKAYEKEVHNVWATHACVPTDPNPQ
EMVLKNVTENFNMWENDMVDQMHEDVISLWDQSLKPCVRLTPLCVTLNCINATNATASDSSILDGMKNCSFNITTELR
DKREKKNALFYKLDIVQLGGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNSKTIIVHLNESVKIECTRPSNNTRTSIRIGPGQAFYATGQVI
GNIREAHCNISESKWNETLQRVSEKLKKYFPDKNITFQPSSGGDLEITTHSFNCGGEFFYCNTSSLFNRTYMATSTDL
ANSTETNIITIHCRIKQIINMWQEVGRAMYAPPIAGNITCISNITGLLLTRDGGNNTEDTETFRPVGGNMKDNWSSEL
YKYKVVEVKPLGVAPTNARRRVVKREKRAVGMGAMFLGFLGAAGSTMGAASITLTVQARQLLSGIVQQQSNLLKAIEA
QQHMLKLTVWGIKQLQARVLALERYLKDQQLLGMWGCSGKLICTTNVYWNSSWSNKTYDDIWDNMTWMQWEREISNYT
ELIYELLEESQNQQEKNEQDLLALDRWNSLWNWFNITNWLWYIKIFIMIVGGLIGLRIIFAVLSLVNRVRQG*

>HV1300733

MRVMGRQRNYPQWWIWSMLGLWMLMICNGMWVTVYYGVPVWKEAKTTLFCASDAKGYEKEVHNVWATHACVPTDPNPQ
EMVLKNVTENFNMWENDMVDQMHEDVISLWDQSLKPCVKLTPLCVTLNCTDANATASNANATVSNTNATVSNDSSIIE
EMKNCSFNITTELRDKIEKKYALFYKLDIVQLDGNSTHYRFINCNTSAITQACPKVSFDPIPIHYCAPAGYAILKCNN
KTFNGTGPCNNVSTVQCTHGIKPVVSTQLLLNGSLAEGEIIIRSKNITDNGKTIIVHLNESVKIECTRPSNNTRTSIG
IGPGQAFYATGQVIGDIRKAHCNISESKWNETLQRVSKKLKEYFPGKNITFQPSSGGDPEVTTHSFNCGGEFFYCNTS
SLFNRTYMTNSTDMANSTETNRTITIHCRIKQIINMWQEVGRAMYAPPIAGNITCISNITGLLLTRDGGNSSTETETF
RPEGGNMKDNWRSELYKYKVVEVKPLGVAPTNARRRVVEREKRAVGMGAVFLGFLGAAGSTMGAASITLTVQARQLLS
GIVQQQSNLLKAIEAQQHMLRLTVWGIKQLQARVLALERYLKDQQLLGMWGCSGKLICTTNVYWNSSWSNKTYDDIWD
NMTWMQWEGEISNYTNIIYDLLEESQNQQEKNEQDLLALDRWNSLWNWFNITKWLWYIKIFIMIVGGLIGLRIIFAVL
SLVNRVRQG*

>HV1300734

MRVRGIQRSYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCINATNATDSKSNILEGMKNCSFNITTELR
DKREKKNALFYKLDIVQLGSNSSQYRLINCNTSVITQACPKVSFDPIPIHYCAPAGYAILKCNNKTFNGTGPCNNVST
VQCTHGIKPVVSTQLLLNGSLAEGEIIIRSKNITDNSKTIIVHLNESVKIECTRPSNNTRTSIRIGPGQAFYATGQVI
GNIREAHCNISESKWNETLQRVSEKLKEYFPDKNITFQPSSGGDLEITTHSFNCGGEFFYCNTSSLFNRTYMANSTDM
ANSTETNSTQIITIHCRIKQIINMWQEVGRAMYAPPIAGNITCISNITGLLLTRDGGNNTEDTETFRPVGGNMKDNWS
SELYKYKVVEVKPLGVAPTNARRRVVEREKRAVGMGAVFLGFLGAAGSTMGAASITLTVQARQLLSGIVQQQSNLLKA

Fig. 20 cont.
IEAQQHMLKLTVWGIKQLQARVLALERYLKDQQLLGMWGCSGKLICTTNVYWNSSWSNKTYDDIWDNMTWMQWEREIS
NYTNIIYELLEESQNQQEKNEQDLLALDRWNSLWNWFNITNWLWYIKIFIMIVGGLIGLRIIFAVLSLVNRVRQG*

>HV1300735

MRVRGIQRSYPQWWIWSMLGLWMLMICNGMWVTVYYGVPVWKEAKTTLFCASDAKAYEKEVHNVWATHACVPTDPNPQ
EMVLKNVTENFNMWENDMVDQMHEDVISLWDQSLKPCVRLTPLCVTLNCINATNATASDSSILDGMKNCSFNITTELR
DKREKKNALFYKLDIVQLGGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNSKTIIVHLNESVKIECTRPSNNTRTSIRIGPGQAFYATGQVI
GNIREAHCNISESKWNETLQRVSEKLKKYFPDKNITFQPSSGGDLEITTHSFNCGGEFFYCNTSSLFNRTYMATSTDM
ANSTETNIITIHCRIKQIINMWQEVGRAMYAPPIAGNITCISNITGLLLTRDGGNNTEDTETFRPVGGNMKDNWSSEL
YKYKVVEVKPLGVAPTNARRRVVEREKRAVGMGAVFLGFLGAAGSTMGAASITLTVQARQLLSGIVQQQSNLLKAIEA
QQHMLKLTVWGIKQLQARVLALERYLKDQQLLGMWGCSGKLICTTNVYWNSSWSNKTYSDIWDNMTWMQWEREISNYT
DMIYELLEESQNQQEKNEQDLLALDRWNSLWNWFNITNWLWYIKIFIMIVGGLIGLRIIFAVLSLVNRVRQG*

>HV1300736

MRVRGIQRSYPQWWIWSMLGFWMLMICNGMWVTVYYGVPVWKEAKTTLFCASDAKAYEKEVHNVWATHACVPTDPNPQ
EMVLKNVTENFNMWENDMVDQMHEDVISLWDQSLKPCVKLTPLCVTLNCINATNATASDSSILDGMKNCSFNITTELR
DKREKKNALFYKLDIVQLGSNSSQYRLINCNTSVITQACPKVSFDPIPIHYCAPAGYAILKCNNKTFNGTGPCNNVST
VQCTHGIKPVVSTQLLLNGSLAEGEIIIRSKNITDNSKTIIVHLNESVKIECTRPSNNTRTSIRIGPGQAFYATGQVI
GNIREAHCNISESKWNETLQRVSEKLKEYFPDKNITFQPSSGGDLEITTHSFNCGGEFFYCNTSSLFNRTYMANSTDM
ANSTETNSTQIITIHCRIKQIINMWQEVGRAMYAPPIAGNITCISNITGLLLTRDGGNNTEDTETFRPVGGNMKDNWS
SELYKYKVVEVKPLGVAPTNARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYDDIWDNMTWMQWEREIS
NYTEIIYELLEESQNQQEKNEQDLLALDRWNSLWNWFNITNWLWYIKIFIMIVGGLIGLRIIFAVLSLVNRVRQG*

>HV1300737

MRVRGIQRSYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCINATNATASDSSILDGMKNCSFNITTELR
DKREKKNALFYKLDIVQLGGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNSKTIIVHLNESVKIECTRPSNNTRTSIRIGPGQAFYATGQVI
GNIREAHCNISESKWNETLQRVSEKLKEYFPDKNITFQPSSGGDLEITTHSFNCGGEFFYCNTSSLFNRTYMANSTDM
ANSTETNSTQIITIHCRIKQIINMWQEVGRAMYAPPIAGNITCISNITGLLLTRDGGNNTEDTETFRPVGGNMKDNWS
SELYKYKVVEVKPLGVAPTNARRRVVEREKRAVGMGAVFLGFLGAAGSTMGAASITLTVQARQLLSGIVQQQSNLLKA
IEAQQHMLKLTVWGIKQLQARVLALERYLKDQQLLGMWGCSGKLICTTNVYWNSSWSNKTYSDIWDNMTWMQWEREIS
NYTDMIYELLEESQNQQEKNEQDLLALDRWNSLWNWFNITNWLWYIKIFIMIVGGLIGLRIIFAVLSLVNRVRQG*

>HV1300738

MRVMGRQRNYPQWWIWSTLGLRMLMICNGMWVTVYYGVPVWKEAKTTLFCASDAKAYEKEVHNVWATHACVPTDPNPQ
EMVLKNVTENFNMWENDMVDQMHEDVISLWDQSLKPCVKLTPLCVTLNCTDANATASNANATVSNTNATVSNDSSIIE
EMKNCSFNITTELRDKIEKKYALFYKLDIVQLDGNSTHYRFINCNTSAITQACPKVSFDPIPIHYCAPAGYAILKCNN
KTFNGTGPCNNVSTVQCTHGIKPVVSTQLLLNGSLAEGEIIIRSENITDNAKTIIVHLNESVKIECTRPSNNTRTSIG
IGPGQAFYATGQVIGDIRKAHCNISESKWNETLQRVSKKLKEYFPGKNITFQPSSGGDPEVTTHSFNCGGEFFYCNTS
SLFNRTYMTNSTDMANSTETNRTITIHCRIKQIINMWQEVGRAMYAPPIAGNITCISNITGLLLTRDGGNNTDPEIFR
PGGGNMKDNWRSELYKYKVVEVKPLGVAPTNARRRVVEREKRAVGMGAVFLGFLGAAGSTMGAASITLTVQARQLLSG
IVQQQSNLLKAIEAQQHMLRLTVWGIKQLQARVLALERYLKDQQLLGMWGCSGKLICTTNVYWNSSWSNKTYGDIWDN
MTWMQWESEISNYTNIIYDLLEESQNQQEKNEQDLLALDRWNSLWNWFNITKWLWYIKIFIMIVGGLIGLRIIFAVLS
LVNRVRQG*

>HV1300748

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATANNSNIIEEMKNCSFNITTELRDKR
EKKNALFYKLDIVQLDGNSSQYRLINCNTSVITQACPKVSFDPIPIHYCAPAGYAILKCNNKTFTGTGPCNNVSTVQC

Fig. 20 cont.
THGIKPVVSTQLLLNGSLAEGEIIIRSENITNNVKTIIVHLNESVKIECTRPNNKTRTSIRIGPGQAFYATGQVIGDI
REAYCNINESKWNETLQRVSKKLKEYFPHKNITFQPSSGGDLEITTHSFNCGGEFFYCNTSSLFNRTDMANSTETNST
RTITIHCRIKQIINMWQEVGRAMYAPPIAGNITCISNITGLLLTRDGGKNNTETFRPGGGNMKDNWRSELYKYKVVEV
KPLGVAPTNARRRVVEREKRAVGMGAVFLGFLGAAGSTMGAASITLTVQARQLLSGIVQQQSNLLKAIEAQQHMLKLT
VWGIKQLQARVLALERYLKDQQLLGMWGCSGKLICTTNVYWNSSWSNKTYGDIWDNMTWMQWEREISNYTEIIYELLE
ESQNQQEKNEQDLLALDRWNSLWNWFNITNWLWYIKIFIMIVGGLIGLRIIFAVLSLVNRVRQG\*

>HV1300756

MRVMGIQRNYPQWWIWSMLGFWMLMICNGMWVTVYYGVPVWKEAKTTLFCASDAKAYEKEVHNVWATHACVPTDPNPQ
EMVLKNVTENFNMWKNDMVDQMHEDVISLWDQSLKPCVKLTPLCVTLNCTNATARNCTNATASNSSIIEGMKNCSFNI
TTELRDKREKKNALFYKLDIVQLDGNSSQYRLINCNTSVITQACPKVSFDPIPIHYCAPAGYAILKCNNKTFTGTGPC
NNVSTVQCTHGIKPVVSTQLLLNGSLAEGEIIIRSENITNSGKTIIVHLNESVKIECTRPNNKTRTSIRIGPGQAFYA
TGQVIGDIREAYCNISESKWNETLQRVSKKLKEYFPHKNITFQPSSGGDLEITTHSFNCGGEFFYCNTSSLFNRTYMA
NSTDMANSTETNSTRIITIHCRIKQIINMWQEVGRAMYAPPIAGNITCISSITGLLLTRDGGENNTETFRPGGGNMKD
NWRSELYKYKVVEVKPLGVAPTNARRRVVEREKRAVGMGAVFLGFLGAAGSTMGAASITLTVQARQLLSGIVQQQSNL
LKAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVFSLVNRVRQG
\*

Fig. 21 (DNA sequences of 104 CH505gp145 Envs)

The coding region of CH505 HIV-1 Env gene inserts are in upper case.

>HV1300631
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGTGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCcgcaggcgcgtcgtggagcgcgagaagcgcGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGggatccagatctgctgtgccttt
>HV1300632
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGTGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCcgcaggcgcgtcgtggagcgcgagaagcgcGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT

Fig. 21 cont.

GGTTCAACATCACCAACTGGCTGGGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGaacggatccagatctgctgtgccctt

>HV1300633 gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGTGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGTCcgcaggcgcgtcgtggagcgcgagaagcgcGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGaacgtcggatccagatctgctgtgccctt

>HV1300634 gtcgacaagaagccaccATGCGCGTGATGGGCATCCAGCGCAACTACCCGCAGTGGTGGATCTGGTCGATGCTGGGCTTCTGG
ATGCTCATGATCTGCAACGGCATGTGGGTGACGGTGTACTACGGCGTGCCGGTGTGGAAGGAGGCCAAGACGACCCTGTTCTG
CGCGTCGGACGCCAAGGCCTACGAGAAGGAGGTGCACAACGTGTGGGCGACCCACGCCTGCGTGCCCACGGACCCCAACCCGC
AGGAGATGGTGCTGAAGAACGTGACCGAGAACTTCAACATGTGGAAGAACGACATGGTGGACCAGATGCACGAGGACGTGATC
TCCCTGTGGGACCAGTCCCTGAAGCCCTGCGTGAAGCTGACCCCGCTGTGCGTGACCCTGAACTGCACCAACGCCACCGCGTC
CAACTCCTCCATCATCGAGGGCATGAAGAACTGCTCCTTCAACATCACGACGGAGCTGCGCGACAAGCGCGAGAAGAAGAACG
CCCTGTTCTACAAGCTGGACATCGTGCAGCTGGACGGCAACTCCTCGCAGTACAGGCTGATCAACTGCAACACCTCCGTCATC
ACGCAGGCGTGCCCCAAGGTGTCCTTCGACCCCATCCCCATCCACTACTGCGCCCCGCCGGCTACGCCATCCTGAAGTGCAA
CAACAAGACCTTCACCGGCACCGGCCCGTGCAACAACGTGTCCACCGTGCAGTGCACGCACGGGATCAAGCCCGTGGTGTCCA
CGCAGCTGCTCCTGAACGGGTCGCTGGCCGAGGGCGAGATCATCATCCGGTCCGAGAACATCACGAACAACGGGAAGACCATC
ATCGTGCACCTGAACGAGTCCGTGAAGATCGAGTGCACCCGCCCGAACAACAAGACGCGCACCTCCATCCGGATCGGCCCTGG
CCAGGCCTTCTACGCCACCGGCCAGGTGATCGGCGACATCCGCGAGGCGTACTGCAACATCAACGAGTCCAAGTGGAACGAGA
CCCTGCAGCGCGTGTCCAAGAAGCTGAAGGAGTACTTCCCCCACAAGAACATCACCTTCCAGCCGTCGTCCGGCGGCGACCTC
GAGATCACCACGCACTCCTTCAACTGCGGTGGCGAGTTCTTCTACTGCAACACGTCGTCGCTGTTCAACCGCACCTACATGGC
CAACTCCACCGACATGGCCAACTCCACCGAGACCAACTCCACGCGCATCATCACGATCCACTGCCGCATCAAGCAGATCATCA
ACATGTGGCAGGAGGTGGGCCGCGCCATGTACGCACCGCCCATCGCCGGCAACATCACCTGCATCTCCAACATCACCGGCCTC
CTGCTGACCCGCGACGGCGGCAAGAACAACACGGAGACCTTCAGGCCAGGCGGAGGCAACATGAAGGACAACTGGCGCTCCGA
GCTGTACAAGTACAAGGTGGTGGAGGTGAAGCCCCTGGGCGTGGCACCCACCAACGCCcgcaggcgcgtcgtggagcgcgaga
agcgcGCCGTGGGCATGGGCGCCGTGTTCCTGGGCTTCCTGGGCGCTGCGGGCTCCACCATGGGTGCCGCGTCCATCACCCTG
ACCGTGCAGGCCCGCCAGCTGCTCTCCGGCATCGTGCAGCAGCAGTCCAACCTCCTGAAGGCCATCGAGGCCCAGCAGCACAT
GCTGAAGCTGACCGTGTGGGGCATCAAGCAGCTGCAGGCCAAGGTGCTCGCGCTCGAGCGCTACCTGAAGGACCAGCAGCTGC
TCGGCATGTGGGGCTGCTCCGGCAAGCTGATCTGCACCACCAACGTGTACTGGAACTCGTCCTGGTCCAACAAGACCTACGGC
GACATCTGGGACAACATGACCTGGATGCAGTGGGAGCGCGAGATCTCCAACTACACCGAGATCATCTACGAGCTCCTCGAGGA
GTCCCAGAACCAGCAGGAGAAGAACGAGCAGGATCTGCTCGCGCTGGACCGCTGGAACTCCCTGTGGAACTGGTTCAACATCA
CCAACTGGCTGTGGTACATCAAGATCTTCATCATGATCGTGGGCGGCCTGATCGGCCTGCGCATCATCTTCGCCGTGCTGTCG
CTGGTGAACCGCGTGCGCCAGGGCTGATGAGgtaaccgaattcgggacctggatccagatctgctgtgccctt

```
gtcgacaagaagccaccATGCGCGTGATGGGCATCCAGCGCAACTACCCGCAGTGGTGGATCTGGTCGATGCTGGGCTTCTGG
ATGCTCATGATCTGCAACGGCATGTGGGTGACGGTGTACTACGGCGTGCCGGTGTGGAAGGAGGCCAAGACGACCCTGTTCTG
CGCGTCGGACGCCAAGGCCTACGAGAAGGAGGTGCACAACGTGTGGGCGACCCACGCCTGCGTGCCCACGGACCCCAACCCGC
AGGAGATGGTGCTGAAGAACGTGACCGAGAACTTCAACATGTGGAAGAACGACATGGTGGACCAGATGCACGAGGACGTGATC
TCCCTGTGGGACCAGTCCCTGAAGCCCTGCGTGAAGCTGACCCCGCTGTGCGTGACCCTGAACTGCACCAACGCCACCGCGTC
CAACAACTCCATCATCGAGGGCATGAAGAACTGCTCCTTCAACATCACGACGGAGCTGCGCGACAAGCGCGAGAAGAAGAACG
CCCTGTTCTACAAGCTGGACATCGTGCAGCTGGACGGCAACTCCTCGCAGTACAGGCTGATCAACTGCAACACCTCCGTCATC
ACGCAGGCGTGCCCCAAGGTGTCCTTCGACCCCATCCCCATCCACTACTGCGCCCCCGCCGGCTACGCCATCCTGAAGTGCAA
CAACAAGACCTTCACCGGCACCGGCCCGTGCAACAACGTGTCCACCGTGCAGTGCACGCACGGGATCAAGCCCGTGGTGTCCA
CGCAGCTGCTCCTGAACGGGTCGCTGGCCGAGGGCGAGATCATCATCCGGTCCGAGAACATCACGAACAACGCGAAGACCATC
ATCGTGCACCTGAACGAGTCCGTGAAGATCGAGTGCACCCGCCCGAACAACAAGACGCGCACGTCCATCCGGATCGGCCCTGG
CCAGGCCTTCTACGCCACCGGCCAGGTGATCGGCGACATCCGCAAGGCGTACTGCAACATCTCGGAGTCCAAGTGGAACGAGA
CCCTGCAGCGCGTGTCCAAGAAGCTGAAGGAGTACTTCCCCCACAAGAACATCACCTTCCAGCCGTCGTCCGGCGGCGACCTC
GAGATCACCACGCACTCCTTCAACTGCGGTGGCGAGTTCTTCTACTGCAACACGTCGTCGCTGTTCAACCGCACCTACATGGC
CAACTCCACCGACATGGCCAACTCCACCGAGACCAACTCCACGCGCACCATCACGCTCCACTGCCGCATCAAGCAGATCATCA
ACATGTGGCAGGAGGTGGGCCGCGCCATGTACGCACCGCCCATCCGCGGCAACATCACCTGCATCTCCAACATCACCGGCCTC
CTGCTGACCCGCGACGGCGGCAAGAACAACACGGAGACCTTCAGGCCAGGCGGAGGCAACATGAAGGACAACTGGCGCTCCGA
GCTGTACAAGTACAAGGTGGTGGAGGTGAAGCCCCTGGGCGTGGCACCCACCAACGCCcgcaggcgcgtcgtggagcgcgaga
agcgcGCCGTGGGCATGGGCGCCGTGTTCCTGGGCTTCCTGGGCGCTGCGGGCTCCACCATGGGTGCCGCGTCCATCACCCTG
ACCGTGCAGGCCCGCCAGCTGCTCTCCGGCATCGTGCAGCAGCAGTCCAACCTCCTGAAGGCCATCGAGGCCCAGCAGCACAT
GCTGAAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCAACGTGTACTGGAACTCGTCCTGGTCCAACAAGACCTACGGC
GACATCTGGGACAACATGACCTGGATGCAGTGGGAGCGCGAGATCTCCAACTACACCGAGATCATCTACGAGCTCCTCGAGGA
GTCCCAGAACCAGCAGGAGAAGAACGAGCAGGATCTGCTCGCGCTGGACCGCTGGAACTCCCTGTGGAACTGGTTCAACATCA
CCAACTGGCTGTGGTACATCAAGATCTTCATCATGATCGTGGGCGGCCTGATCGGCCTGCGCATCATCTTCGCCGTGCTGTCG
CTGGTGAACCGCGTGCGCCAGGGCTGATGAGggacccgaattcggtcaccggatccagatctgctgtgccttt
```

>HV1300636

```
gtcgacaagaagccaccATGCGCGTGATGGGCATCCAGCGCAACTACCCGCAGTGGTGGATCTGGTCGATGCTGGGCTTCTGG
ATGCTCATGATCTGCAACGGCATGTGGGTGACGGTGTACTACGGCGTGCCGGTGTGGAAGGAGGCCAAGACGACCCTGTTCTG
CGCGTCGGACGCCAAGGCCTACGAGAAGGAGGTGCACAACGTGTGGGCGACCCACGCCTGCGTGCCCACGGACCCCAACCCGC
AGGAGATGGTGCTGAAGAACGTGACCGAGAACTTCAACATGTGGAAGAACGACATGGTGGACCAGATGCACGAGGACGTGATC
TCCCTGTGGGACCAGTCCCTGAAGCCCTGCGTGAAGATGACCCCGCTGTGCGTGACCCTGAACTGCACCAACGCCACCGCGAT
CAACTCCTCCATCATCGAGGGCATGAAGAACTGCTCCTTCAACATCACGACGGAGCTGCGCGACAAGCGCGAGAAGAAGAACG
CCCTGTTCTACAAGCTGGACATCGTGCAGCTGGACGGCAACTCCTCGCAGTACAGGCTGATCAACTGCAACACCTCCGTCATC
ACGCAGGCGTGCCCCAAGGTGTCCTTCGACCCCATCCCCATCCACTACTGCGCCCCCGCCGGCTACGCCATCCTGAAGTGCAA
CAACAAGACCTTCACCGGCACCGGCCCGTGCAACAACGTGTCCACCGTGCAGTGCACGCACGGGATCAAGCCCGTGGTGTCCA
CGCAGCTGCTCCTGAACGGGTCGCTGGCCGAGGGCGAGATCATCATCCGGTCCGAGAACATCACGAACAACGACAAGACCATC
ATCGTGCACCTGAACGAGTCCGTGAAGATCGAGTGCACCCGCCCGAACAACAAGACGCGCACCTCCATCCGGATCGGCCCTGG
CCAGGCCTTCTACGCCACCGGCCAGGTGATCGGCGACATCCGCGAGGCGCACTGCAACATCTCGGAGTCCAAGTGGAACGAGA
CCCTGCAGCGCGTGTCCAAGAAGCTGAAGGAGTACTTCCCCCACAAGAACATCACCTTCCAGCCGTCGTCCGGCGGCGACCTC
GAGATCACCACGCACTCCTTCAACTGCGGTGGCGAGTTCTTCTACTGCAACACGTCGTCGCTGTTCAACCGCACCTACATGGC
CAACTCCACCGACATGGCCAACTCCACCGAGACCAACTCCACGCGCACCATCACGCTCCACTGCCGCATCAAGCAGATCATCA
ACATGTGGCAGGAGGTGGGCCGCGCCATGTACGCACCGCCCATCGCCGGCAACATCACCTGCATCTCCAACATCACCGGCCTC
CTGCTGACCCGCGACGGCGGCAAGAACAACACGGAGACCTTCAGGCCAGGCGGAGGCAACATGAAGGACAACTGGCGCTCCGA
GCTGTACAAGTACAAGGTGGTGGAGGTGAAGCCCCTGGGCGTGGCACCCACCAACGCCcgcaggcgcgtcgtggagcgcgaga
agcgcGCCGTGGGCATGGGCGCCGTGTTCCTGGGCTTCCTGGGCGCTGCGGGCTCCACCATGGGTGCCGCGTCCATCACCCTG
ACCGTGCAGGCCCGCCAGCTGCTCTCCGGCATCGTGCAGCAGCAGTCCAACCTCCTGAAGGCCATCGAGGCCCAGCAGCACAT
GCTGAAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCAACGTGTACTGGAACTCGTCCTGGTCCAACAAGAGCTACGGC
GACATCTGGGACAACATGACCTGGATGCAGTGGGAGCGCGAGATCTCCAACTACACCGAGATCATCTACGAGCTCCTCGAGGA
GTCCCAGAACCAGCAGGAGAAGAACGAGCAGGATCTGCTCGCGCTGGACCGCTGGAACTCCCTGTGGAACTGGTTCAACATCA
CCAACTGGCTGTGGTACATCAAGATCTTCATCATGATCGTGGGCGGCCTGATCGGCCTGCGCATCATCTTCGCCGTGCTGTCG
CTGGTGAACCGCGTGCGCCAGGGCTGATGAGggtcctgaattcggttaccggatccagatctgctgtgccttt
```

```
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGATGACCCCGCTGTGCGTGACCCTGAACTGCACCAACGCCACCGCGATCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGACAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCTCGGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACAACACGCGCCCCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCATCGCACCCACCAACGCCcgcaggcgcgtcgtggagcgcgagaagcgcGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTAGTAAGggtcctgaattcggtcaccggatccagatctgctgtgcctt
>HV1300638 gtcgacaagaagccaccATGCGCGTGATGGGCATCCAGCGCAACTACCCGCAGTGGTGGATCTGGTCGATGCTGGGCTTCTGG
ATGCTCATGATCTGCAACGGCATGTGGGTGACGGTGTACTACGGCGTGCCGGTGTGGAAGGAGGCCAAGACGACCCTGTTCTG
CGCGTCGGACGCCAAGGCCTACGAGAAGGAGGTGCACAACGTGTGGGCGACCCACGCCTGCGTGCCCACGGACCCCAACCCGC
AGGAGATGGTGCTGAAGAACGTGACCGAGAACTTCAACATGTGGAAGAACGACATGGTGGACCAGATGCACGAGGACGTGATC
TCCCTGTGGGACCAGTCCCTGAAGCCCTGCGTGAAGCTGACCCCGCTGTGCGTGACCCTGAACTGCACCGACGCCACCGCGTC
CAACGCAACCGCGAGCAACGCCACGGCGTCGAACTCCTCCATCATCGAGGGCATGAAGAACTGCTCCTTCAACATCACGACGG
AGCTGCGCGACAAGCGCGAGAAGAAGAACGCCCTGTTCTACAAGCTGGACATCGTGCAGCTGGACGGCAACTCCTCGCAGTAC
AGGCTGATCAACTGCAACACCTCCGTCATCACGCAGGCGTGCCCCAAGGTGTCCTTCGACCCCATCCCCATCCACTACTGCGC
CCCCGCCGGCTACGCCATCCTGAAGTGCAACAACAAGACCTTCAACGGCACCGGCCCGTGCAACAACGTGTCCACCGTGCAGT
GCACGCACGGGATCAAGCCCGTGGTGTCCACGCAGCTGCTCCTGAACGGGTCGCTGGCCGAGGGCGAGATCATCATCCGGTCC
GAGAACATCACGGACAACGGGAAGACCATCATCGTGCACCTGAACGAGTCCGTGAAGATCGAGTGCACCCGCCCGTCGAACAA
CACGCGCACCTCCATCCGGATCGGCCCTGGCCAGGCCTTCTACGCCACCGGCCAGGTGATCGGCGACATCCGCGAGGCGCACT
GCAACATCTCGGAGTCCAAGTGGAACGAGACCCTGCAGCGCGTGTCCAAGAAGCTGAAGGAGTACTTCCCCCACAAGAACATC
ACCTTCCAGCCGTCGTCCGGCGGCGACCTCGAGATCACCACGCACTCCTTCAACTGCGGTGGCGAGTTCTTCTACTGCAACAC
GTCGTCGCTGTTCAACCGCACCTACATGGCCAACTCCACCGAGACCAACTCCACGCGCATCATCACGATCCGCTGCCGCATCA
AGCAGATCATCAACATGTGGCAGGAGGTGGGCCGCGCCATGTACGCACCGCCCATCGCCGGCAACATCACCTGCATCTCCAAC
ATCACCGGCCTCCTGCTGACCCGCGACGGCGGCAACAACAACACGGAGACCTTCAGGCCAGGCGGAGGCAACATGAAGGACAA
CTGGCGCTCCGAGCTGTACAAGTACAAGGTGGTGGAGGTGAAGCCCCTGGGCGTGGCACCCACCAACGCCcgcaggcgcgtcg
tggagcgcgagaagcgcGCCGTGGGCATGGGCGCCGTGTTCCTGGGCTTCCTGGGCGCTGCGGGCTCCACCATGGGTGCCGCG
TCCATCACCCTGACCGTGCAGGCCCGCCAGCTGCTCTCCGGCATCGTGCAGCAGCAGTCCAACCTCCTGAAGGCCATCGGGGC
CCAGCAGCACATGCTGAAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCAACGTGTACTGGAACTCGTCCTGGTCCAAC
AAGACCTACGGCGACATCTGGGACAACATGACCTGGATGCAGTGGGAGCGCGAGATCTCCAACTACACCGAGATGATCTACGA
GCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTC
GCCGTGCTGTCGCTGGTGAACCGCGTGCGCCAGGGCTGATGAGaattcggtgaccgggacctggatccagatctgctgtgcct
t
>HV1300639 gtcgacaagaagccaccATGCGCGTGATGGGCATCCAGCGCAACTACCCGCAGTGGTGGATCTGGTCGATGCTGGGCTTCTGG
ATGCTCATGATCTGCAACGGCATGTGGGTGACGGTGTACTACGGCGTGCCGGTGTGGAAGGAGGCCAAGACGACCCTGTTCTG
CGCGTCGGACGCCAAGGCCTACGAGAAGGAGGTGCACAACGTGTGGGCGACCCACGCCTGCGTGCCCACGGACCCCAACCCGC
```

Fig. 21 cont.

AGGAGATGGTGCTGAAGAACGTGACCGAGAACTTCAACATGTGGAAGAACGACATGGTGGACCAGATGCACGAGGACGTGATC
TCCCTGTGGGACCAGTCCCTGAAGCCCTGCGTGAAGCTGACCCCGCTGTGCGTGACCCTGAGCTGCACGAACGCCACCAACGC
GACGGCGTCGAACTCGTCCATCCTCGAGGGGATGAAGAACTGCTCCTTCAACATCACGACGGAGCTGCGCGACAAGCGCGAGA
AGAAGAACGCCCTGTTCTACAAGCTGGACATCGTGCAGCTGGACGGCAACTCCTCGCAGTACAGGCTGATCAACTGCAACACC
TCCGTCATCACGCAGGCGTGCCCCAAGGTGTCCTTCGACCCCATCCCCATCCACTACTGCGCCCCGCCGGCTACGCCATCCT
GAAGTGCAACAACAAGACCTTCAACGGCACCGGCCCGTGCAACAACGTGTCCACCGTGCAGTGCACGCACGGGATCAAGCCCG
TGGTGTCCACGCAGCTGCTCCTGAACGGGTCGCTGGCCGAGGGCGAGATCATCATCCGGTCGAAGAACATCACGGACAACGGG
AAGACCATCATCGTGCACCTGAACGAGTCCGTGAAGATCGAGTGCACCCGCCCGAGCAACAACACGCGCACCTCCATCCGGAT
CGGCCCTGGCCAGGCCTTCTACGCCACCGGCCAGGTGATCGGCGACATCCGCGAGGCGCACTGCAACATCTCCGAGTCCAAGT
GGAACGAGACCCTGCAGCGCGTGTCCGAGAAGCTGAAGGAGTACTTCCCCCACAAGAACATCACCTTCCAGCCGTCGTCCGGC
GGCGACCTCGAGATCACCACGCACTCCTTCAACTGCGGTGGCGAGTTCTTCTACTGCAACACGTCGTCGCTGTTCAACCGCAC
CTACATGGCCACCTCCACCGACATGGCCAACTCCACCGAGACCAACTCCACCGCATCATCACGATCCGCTGCCGCATCAAGC
AGATCATCAACATGTGGCAGGAGGTGGGCCGCGCCATGTACGCACCGCCCATCGCCGGCAACATCACCTGCATCTCCAACATC
ACCGGCCTCCTGCTGACCCGCGACGGCGGCAAGAACGACACGGACACCTTCAGGCCAGAGGGAGGCAACATGAAGGACAACTG
GCGCTCCGAGCTGTACAAGTACAAGGTGGTGGAGGTGAAGCCCCTGGGCGTGGCACCCACCAACGCCcgcaggcgcgtcgtgg
agcgcgagaagcgcGCCGTGGGCATGGGCGCCGTGTTCCTGGGCTTCCTGGGCGCTGCGGGCTCCACCATGGGTGCCGCGTCC
ATCACCCTGACCGTGCAGGCCCGCCAGCTGCTCTCCGGCATCGTGCAGCAGCAGTCCAACCTCCTGAAGGCCATCGAGGCCCA
GCAGCACATGCTGAAGCTGACCGTGTGGGCATCAAGCAGCTGCAGGCCAGGGTGCTCGCGCTCGAGCGCTACCTGAAGGACC
AGCAGCTGCTCGGCATGTGGGGCTGCTCCGGCAAGCTGATCTGCACCACCAACGTGTACTGGAACTCGTCCTGGTCCAACAAG
ACCTACGGCGACATCTGGGACAACATGACCTGGATGCAGTGGGAGCGCGAGATCTCCAACTACACCGAGCTGATCTACGAGCT
CCTCGAGGAGTCCCAGAACCAGCAGGAGAAGAACGAGCAGGATCTGCTCGCGCTGGACCGCTGGAACTCCCTGTGGAACTGGT
TCAACATCACCAACTGGCTGTGGTACATCAAGATCTTCATCATGATCGTGGGCGGCCTGATCGGCCTGCGCATCATCTTCGCC
GTGCTGTCGCTGGTGAACCGCGTGCGCCAGGGCTGATGAGaattcggtcaccgggtcctggatccagatctgctgtgccctt
>HV1300640 gtcgacaagaagccaccATGCGCGTGATGGGCCGCCAGCGCAACTACCCGCAGTGGTGGATCTGGTCGATGCTGGGCCTGTGG
ATGCTCATGATCTGCAACGGCATGTGGGTGACGGTGTACTACGGCGTGCCGGTGTGGAAGGAGGCCAAGACGACCCTGTTCTG
CGCGTCGGACGCCAAGGCCTACGAGAAGGAGGTGCACAACGTGTGGGCGACCCACGCCTGCGTGCCCACGGACCCCAACCCGC
AGGAGATGGTGCTGAAGAACGTGACCGAGAACTTCAACATGTGGGAGAACGACATGGTGGACCAGATGCACGAGGACGTGATC
TCCCTGTGGGACCAGTCCCTGAAGCCCTGCGTGAAGCTGACCCCGCTGTGCGTGACCCTGAACTGCACGGACGCCAACGCCAC
CGCGTCCAACACGAACGCGACAGCGTCCAACATCAACGCGACAGCATCGAAGAACTCCATCATCGAGGAGATGAAGAACTGCT
CCTTCAACATCACGACGGAGCTGCGCGACAAGCGCGAGAAGAAGTACGCCCTGTTCTACAAGCTGGACATCGTGCAGCTGGAC
GGCAACTCCTCGCAGTACAGGCTGATCAACTGCAACACCTCCGTCATCACGCAGGCGTGCCCCAAGGTGTCCTTCGACCCCAT
CCCCATCCACTACTGCGCCCCGCCGGCTACGCCATCCTGAAGTGCAACAACAAGACCTTCAACGGCACCGGCCCCGTGCAACA
ACGTGTCCACCGTGCAGTGCACGCACGGGATCAAGCCCGTGGTGTCCACGCAGCTGCTCCTGAACGGGTCGCTGGCCGAGGGC
GAGATCATCATCCGGTCGAAGAACATCACGGACAACGGGAAGACCATCATCGTGCACCTGAACGAGTCCGTGAAGATCGAGTG
CACCCGCCCGAGCAACAACACGCGCACCTCCATCCGGATCGGCCCTGGCCAGGCCTTCTACGCCACCGGCCAAGTGATCGGCG
ACATCCGCGAGGCGCACTGCAACATCTCCGAGTCCAAGTGGAACGAGACCCTGCAGCGCGTGTCCAAGAAGCTGAAGGAGTAC
TTCCCCGACAAGAACATCACCTTCCAGTCGTCGTCCGGCGGCGACCCGGAGATCACCACGCACTCCTTCAACTGCGGTGGCGA
GTTCTTCTACTGCAACACGTCGTCCCTGTTCAACCGCACCTACATGGCGAACTCCACCGACATGGCCAACTCCACCGAGACCA
ACTCCACGCGCATCATCACGATCCGCTGCCGCATCAAGCAGATCATCAACATGTGGCAGGAGGTGGGCCGCGCCATGTACGCA
CCGCCCATCGCCGGCAACATCACCTGCATCTCCAACATCACCGGCCTCCTGCTGACCCGCGACGGCGGCAACTCTTCCACGGA
GACCTTCAGGCCAGAGGGAGGCAACATGAAGGACAACTGGCGCTCCGAGCTGTACAAGTACAAGGTGGTGGAGGTGAAGCCCC
TGGGCGTGGCACCCACCAACGCCcgcaggcgcgtcgtggagcgcgagaagcgcGCCGTGGGCATGGGCGCCGTGTTCCTGGGC
TTCCTGGGCGCTGCGGGCTCCACCATGGGTGCCGCGTCCATCACCCTGACCGTGCAGGCCCGCCAGCTGCTCTCCGGCATCGT
GCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGC
ACCACCAACGTGTACTGGAACTCGTCCTGGTCCAACAAGACCTACGACGACATCTGGGACAACATGACCTGGATGCAGTGGGA
GCGCGAGATCTCCAACTACACCGAGATGATCTACGACCTCCTCGAGGAGTCCCAGAACCAGCAGGAGAAGAACGAGCAGGATC
TGCTCGCGCTGGACCGCTGGAACTCCCTGTGGAACTGGTTCAACATCACCAAGTGGCTGTGGTACATCAAGATCTTCATCATG
ATCGTGGGCGGCCTGATCGGCCTGCGCATCATCTTCGCCGTGCTGTCGCTGGTGAACCGCGTGCGCCAGGGCTGATGAGgtca
ccgggacccgaattcggatccagatctgctgtgccctt >HV1300641
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT

Fig. 21 cont.

```
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCCGCCGGCTACGTCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGTGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCAAGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCcgcaggcgcgtcgtggagcgcgagaagcgcGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTAGTAAGgtaaccgaattcgggtcccggatccagatctgctgtgccttt
>HV1300642 gtcgacaagaagccaccATGCGCGTGATGGGCATCCAGCGCAACTACCCGCAGTGGTGGATCTGGTCGATGCTGGGCTTCTGG
ATGCTCATGATCTGCAACGGCATGTGGGTGACGGTGTACTACGGCGTGCCGGTGTGGAAGGAGGCCAAGACGACCCTGTTCTG
CGCGTCGGACGCCAAGGCCTACGAGAAGGAGGTGCACAACGTGTGGGCGACCCACGCCTGCGTGCCCACGGACCCCAACCCGC
AGGAGATGTTCCTGAAGAACGTGACCGAGAACTTCAACATGTGGAAGAACGACATGGTGGACCAGATGCACGAGGACGTGATC
TCCCTGTGGGACCAGTCCCTGAAGCCCTGCGTGAAGCTGACCCCGCTGTGCGTGACCCTGAACTGCACCAACGCCACCGCGTC
CAACTCCTCCATCATCGAGCGGATGAAGAACTGCTCCTTCAACATCACGACGGAGCTGCGCGACAAGCGCGAGAAGAAGAACG
CCCTGTTCTACAAGCTGGACATCGTGCAGCTGGACGGCAACTCCTCGCAGTACAGGCTGATCAACTGCAACACCTCCGTCATC
ACGCAGGCGTGCCCCAAGGTGTCCTTCGACCCCATCCCCATCCACTACTGCGCCCCCGCCGGCTACGCCATCCTGAAGTGCAA
CAACAAGACCTTCACCGGCACCGGCCCGTGCAACAACGTGTCCACCGTGCAGTGCACGCACGGGATCAAGCCCGTGGTGTCCA
CGCAGCTGCTCCTGAACGGTCGCTGGCCGAGGGCGAGATCATCATCCGGTCCGAGAACATCACGAACAACGTGAAGACCATC
ATCGTGCACCTGAACGAGTCCGTGAAGATCGAGTGCACCCGCCCGAACAACAAGACGCGCACCTCCATCCGGATCGGCCCTGG
CCAGGCCTTCTACGCCACCGGCCAGGTGATCGGCGACATCCGCGAGGCGTACTGCAACATCAACGAGTCCAAGTGGAACGAGA
CCCTGCAGCGCGTGTCCAAGAAGCTGAAGGAGTACTTCCCCCACAAGAACATCACCTTCCAGCCGTCGTCCGGCGGCGACCTC
GAGATCACCACGCACTCCTTCAACTGCGGTGGCGAGTTCTTCTACTGCAACACGTCGTCGCTGTTCAACCGCACCTACATGGC
CAACTCCACCGACATGGCCAACTCCACCGAGACCAACTCCACGCGCACCATCACGATCCGCTGCCGCATCAAGCAGATCATCA
ACATGTGGCAGGAGGTGGGCCGCGCCATGTACGCACCGCCCATCGCCGGCAACATCACCTGCATCTCCAACATCACCGGCCTC
CTGCTGACCCGCGACGGCGGCAAGAACAACACGGAGACCTTCAGGCCAGGCGGAGGCAACATGAAGGACAACTGGCGCTCCGA
GCTGTACAAGTACAAGGTGGTGGAGGTGAAGCCCCTGGGCGTGGCACCCACCAACGCCCGCAGGCGCGTCGTGGAGCGCGAGA
AGCGCGCCGTGGGCATGGGCGCCGTGTTCCTGGGCTTCCTGGGCGCTGCGGGCTCCACCATGGGTGCCGCGTCCATCACCCTG
ACCGTGCAGGCCCGCCAGCTGCTCTCCGGCATCGTGCAGCAGCAGTCCAACCTCCTGAAGGCCATCGAGGCCCAGCAGCACAT
GCTGAAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCAACGTGTACTGGAACTCGTCCTGGTCCAACAAGACCTACGGC
GACATCTGGGACAACATGACCTGGATGCAGTGGGAGCGCGAGATCTCCAACTACACCGAGATCATCTACGAGCTCCTCGAGGA
GTCCCAGAACCAGCAGGAGAAGAACGAGCAGGATCTGCTCGCGCTGGACCGCTGGAACTCCCTGTGGAACTGGTTCAACATCA
CCAACTGGCTGTGGTACATCAAGATCTTCATCATGATCGTGGGCGGCCTGATCGGCCTGCGCATCATCTTCGCCGTGCTGTCG
CTGGTGAACCGCGTGCGCCAGGGCTGATGAGgtaaccgaattcaggacccggatccagatctgctgtgccttt
>HV1300643 gtcgacaagaagccaccATGCGCGTGATGGGCATCCAGCGCAACTACCCGCAGTGGTGGATCTGGTCGATGCTGGGCTTCTGG
ATGCTCATGATCTGCAACGGCATGTGGGTGACGGTGTACTACGGCGTGCCGGTGTGGAAGGAGGCCAAGACGACCCTGTTCTG
CGCGTCGGACGCCAAGGCCTACGAGAAGGAGGTGCACAACGTGTGGGCGACCCACGCCTGCGTGCCCACGGACCCCAACCCGC
AGGAGATGGTGCTGAAGAACGTGACCGAGAACTTCAACATGTGGAAGAACGACATGGTGGACCAGATGCACGAGGACGTGATC
TCCCTGTGGGACCAGTCCCTGAAGCCCTGCGTGAAGCTGACCCCGCTGTGCGTGACCCTGAACTGCACCAACGCCAACGCGTC
CAACAACTCCATCATCGAGGGCATGAAGAACTGCTCCTTCAACATCACGACGGAGCTGCGCGACAAGCGCGAGAAGAAGAACG
CCCTGTTCTACAAGCTGGACATCGTGCAGCTGGACGGCAACTCCTCGCAGTACAGGCTGATCAACTGCAACACCTCCGTCATC
ACGCAGGCGTGCCCCAAGGTGTCCTTCGACCCCATCCCCATCCACTACTGCGCCCCCGCCGGCTACGCCATCCTGAAGTGCAA
```

Fig. 21 cont.

```
CAACAAGACCTTCACCGGCACCGGCCCGTGCAACAACGTGTCCACCGTGCAGTGCACGCACGGGATCAAGCCCGTGGTGTCCA
CGCAGCTGCTCCTGAACGGGTCGCTGGCCGAGGGCGAGATCATCATCCGGTCCGAGAACATCACGAACAACGGGAAGACCATC
ATCGTGCACCTGAACGAGTCCGTGAAGATCGAGTGCACCCGCCCGAACAACAAGACGCGCACCTCCATCCGGATCGGCCCTGG
CCAGGCCTTCTACGCCACCGGCCAGGTGATCGGCGACATCCGCGAGGCGTACTGCAACATCTCGGAGTCCAAGTGGAACGAGA
CCCTGCAGCGCGTGTCCAAGAAGCTGAAGGAGTACTTCCCCCACAAGAACATCACCTTCCAGCCGTCGTCCGGCGGCGACCTC
GAGATCACCACGCACTCCTTCAACTGCGGTGGCGAGTTCTTCTACTGCAACACGTCGTCGCTGTTCAACCGCACCTACATGGC
CAACTCCACCGACATGGCCAACTCCACCGAGACCAACTCCACGCGCATCATCACGATCCACTGCCGCATCAAGCAGATCATCA
ACATGTGGCAGGAGGTGGGCCGCGCCATGTACGCACCGCCCATCGCCGGCAACATCACCTGCATCTCCAACATCACCGGCCTC
CTGCTGACCCGCGACGGCGGCAAGAACAACACGGAGACCTTCAGGCCAGGCGGAGGCAACATGAAGGACAACTGGCGCTCCGA
GCTGTACAAGTACAAGGTGGTGGAGGTGAAGCCCCTGGGCGTGGCACCCACCAACGCCCGCAGGCGCGTCGTGGAGCGCGAGA
AGCGCGCCGTGGGCATGGGCGCCGTGTTCCTGGGCTTCCTGGGCGCTGCGGGCTCCACCATGGGTGCCGCGTCCATCACCCTG
ACCGTGCAGGCCCGCCAGCTGCTCTCCGGCATCGTGCAGCAGCAGTCCAACCTCCTGAAGGCCATCGAGGCCCAGCAGCACAT
GCTGAAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCAACGTGTACTGGAACTCGTCCTGGTCCAACAAGACCTACGGC
GACATCTGGGACAACATGACCTGGATGCAGTGGGAGCGCGAGATCTCCAACTACACCGAGATCATCTACGAGCTCCTCGAGGA
GTCCCAGAACCAGCAGGAGAAGAACGAGCAGGATCTGCTCGCGCTGGACCGCTGGAACTCCCTGTGGAACTGGTTCAACATCA
CCAACTGGCTGTGGTACATCAAGATCTTCATCATGATCGTGGGCGGCCTGATCGGCCTGCGCATCATCTTCGCCGTGCTGTCG
CTGGTGAACCGCGTGCGCCAGGGCTGATGAGgttaccgaattcaggacccggatccagatctgctgtgcctt

>HV1300644 gtcgacaagaagccaccATGCGCGTGATGGGCATCCAGCGCAACTACCCGCAGTGGTGGATCTGGTCGATGCTGGGCTTCTGG
ATGCTCATGATCTGCAACGGCATGTGGGTGACGGTGTACTACGGCGTGCCGGTGTGGAAGGAGGCCAAGACGACCCTGTTCTG
CGCGTCGGACGCCAAGGCCTACGAGAAGGAGGTGCACAACGTGTGGGCGACCCACGCCTGCGTGCCCACGGACCCCAACCCGC
AGGAGATGGTGCTGAAGAACGTGACCGAGAACTTCAACATGTGGAAGAACGACATGGTGGACCAGATGCACGAGGACGTGATC
TCCCTGTGGGACCAGTCCCTGAAGCCCTGCGTGAAGCTGACCCCGCTGTGCGTGACCCTGAACTGCACCAACGCCACCGCGTC
CAACATCTCCATCATCGAGGGCATGAAGAACTGCTCCTTCAACATCACGACGGAGCTGCGCGACAAGCGCGAGAAGAAGAACG
CCCTGTTCTACAAGCTGGACATCGTGCAGCTGGACGGCAACTCCTCGCAGTACAGGCTGATCAACTGCAACACCTCCGTCATC
ACGCAGGCGTGCCCCAAGGTGTCCTTCGACCCCATCCCCATCCACTACTGCGCCCCCGCCGGCTACGCCATCCTGAAGTGCAA
CAACAAGACCTTCACCGGCACCGGCCCGTGCAACAACGTGTCCACCGTGCAGTGCACGCACGGGATCAAGCCCGTGGTGTCCA
CGCAGCTGCTCCTGAACGGGTCGCTGGCCGAGGGCGAGATCATCATCCGGTCCGAGAACATCACGAACAACGGGAAGACCATC
ATCGTGCACCTGAACGAGTCCGTGAAGATCGAGTGCACCCGCCCGAACAACAAGACGCGCACCTCCATCCGGATCGGCCCTGG
CCAGGCCTTCTACGCCACCGGCCAGGTGATCGGCGACATCCGCGAGGCGTACTGCAACATCTCGGAGTCCAAGTGGAACGAGA
CCCTGCAGCGCGTGTCCAAGAAGCTGAAGGAGTACTTCCCCCACAAGAACATCACCTTCCAGCCGTCGTCCGGCGGCGACCTC
GAGATCACCACGCACTCCTTCAACTGCGGTGGCGAGTTCTTCTACTGCAACACGTCGTCGCTGTTCAACCGCACCTACATGGC
CAACTCCACCGACATGGCCAACTCCACCGAGACCAACTCCACGCGCATCATCACGATCCACTGCCGCATCAAGCAGATCATCA
ACATGTGGCAGGAGGTGGGCCGCGCCATGTACGCACCGCCCATCGCCGGCAACATCACCTGCATCTCCAACATCACCGGCCTC
CTGCTGACCCGCGACGGCGGCAAGAACAACACGGAGACCTTCAGGCCAGGCGGAGGCAACATGAAGGACAACTGGCGCTCCGA
GCTGTACAAGTACAAGGTGGTGGAGGTGAAGCCCCTGGGCGTGGCACCCACCAACGCCCGCAGGCGCGTCGTGGAGCGCGAGA
AGCGCGCCGTGGGCATGGGCGCCGTGTTCCTGGGCTTCCTGGGCGCTGCGGGCTCCACCATGGGTGCCGCGTCCATCACCCTG
ACCGTGCAGGCCCGCCAGCTGCTCTCCGGCATCGTGCAGCAGCAGTCCAACCTCCTGAAGGCCATCGAGGCCCAGCAGCACAT
GCTGAAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCAACGTGTACTGGAACTCGTCCTGGTCCAACAAGACCTACGGC
GACATCTGGGACAACATGACCTGGATGCAGTGGGAGCGCGAGATCTCCAACTACACCGAGATCATCTACGAGCTCCTCGAGGA
GTCCCAGAACCAGCAGGAGAAGAACGAGCAGGATCTGCTCGCGCTGGACCGCTGGAACTCCCTGTGGAACTGGTTCAACATCA
CCAACTGGCTGTGGTACATCAAGATCTTCATCATGATCGTGGGCGGCCTGATCGGCCTGCGCATCATCTTCGCCGTGCTGTCG
CTGGTGAACCGCGTGCGCCAGGGCTGATGAGggacctgaattcggtgaccggatccagatctgctgtgcctt

>HV1300645 gtcgacaagaagccaccATGCGCGTGATGGGCATCCAGCGCAACTACCCGCAGTGGTGGATCTGGTCGATGCTGGGCTTCTGG
ATGCTCATGATCTGCAACGGCATGTGGGTGACGGTGTACTACGGCGTGCCGGTGTGGAAGGAGGCCAAGACGACCCTGTTCTG
CGCGTCGGACGCCAAGGCCTACGAGAAGGAGGTGCACAACGTGTGGGCGACCCACGCCTGCGTGCCCACGGACCCCAACCCGC
AGGAGATGGTGCTGAAGAACGTGACCGAGAACTTCAACATGTGGAAGAACGACATGGTGGACCAGATGCACGAGGACGTGATC
TCCCTGTGGGACCAGTCCCTGAAGCCCTGCGTGAAGCTGACCCCGCTGTGCGTGACCCTGAACTGCACCAACGCCACCGCGTCCAA
CTCCTCCATCATCGAGGGCATGAAGAACTGCTCCTTCAACATCACGACGGAGCTGCGCGACAAGCGCGAGAAGAAGAACGCCC
TGTTCTACAAGCTGGACATCGTGCAGCTGGACGGCAACTCCTCGCAGTACAGGCTGATCAACTGCAACACCTCCGTCATCACG
CAGGCGTGCCCCAAGGTGTCCTTCGACCCCATCCCCATCCACTACTGCGCCCCCGCCGGCTACGCCATCCTGAAGTGCAACAA
CAAGACCTTCACCGGCACCGGCCCGTGCAACAACGTGTCCACCGTGCAGTGCACGCACGGGATCAAGCCCGTGGTGTCCACGC
```

Fig. 21 cont.

```
AGCTGCTCCTGAACGGGTCGCTGGCCGAGGGCGAGATCATCATCCGGTCCGAGAACATCACGAACAACGCGAAGACCATCATC
GTGCACCTGAACGAGTCCGTGAAGATCGAGTGCACCCGCCCGAACAACAAGACGCGCACCTCCATCCGGATCGGCCCTGGCCA
GGCCTTCTACGCCACCGGCCAGGTGATCGGCGACATCCGCAAGGCGTACTGCAACATCAACGAGTCCAAGTGGAACGAGACCC
TGCAGCGCGTGTCCAAGAAGCTGAAGGAGTACTTCCCCCACAAGAACATCACCTTCCAGCCGTCGTCCGGCGGCGACCTCGAG
ATCACCACGCACTCCTTCAACTGCGGTGGCGAGTTCTTCTACTGCAACACGTCGTCGCTGTTCAACCGCACCTACATGGCCAA
CTCCACCGACATGGCCAACTCCACCGAGACCAACAACACGCGCACCATCACGATCCACTGCCGCATCAAGCAGATCATCAACA
TGTGGCAGGAGGTGGGCCGCGCCATGTACGCACCGCCCATCGCCGGCAACATCACCTGCATCTCCAACATCACCGGCCTCCTG
CTGACCCGCGACGGCGGCAAGAACAACACGGAGACCTTCAGGCCAGGCGGAGGCAACATGAAGGACAACTGGCGCTCCGAGCT
GTACAAGTACAAGGTGGTGGAGGTGAAGCCCCTGGGCGTGGCACCCACCAACGCCCGCAGGCGCGTCGTGGAGCGCGAGAAGC
GCGCCGTGGGCATGGGCGCCGTGTTCCTGGGCTTCCTGGGCGCTGCGGGCTCCACCATGGGTGCCGCGTCCATCACCCTGACC
GTGCAGGCCCGCCAGCTGCTCTCCGGCATCGTGCAGCAGCAGTCCAACCTCCTGAAGGCCATCGAGGCCCAGCAGCACATGCT
GAAGCTGACCGTGTGGGGCATCAAGCAGCTGCAGGCCAGGGTGCTCGCGCTCGAGCGCTACCTGAAGGACCAGCAGCTGCTCG
GCATGTGGGGCTGCTCCGGCAAGCTGATCTGCACCACCAACGTGTACTGGAACTCGTCCTGGTCCAACAAGACCTACGGCGAC
ATCTGGGACAACATGACCTGGATGCAGTGGGAGCGCGAGATCTCCAACTACACCGAGATCATCTACGAGCTCCTCGAGGAGTC
CCAGAACCAGCAGGAGAAGAACGAGCAGGATCTGCTCGCGCTGGACCGCTGGAACTCCCTGTGGAACTGGTTCAACATCACCA
ACTGGCTGTGGTACATCAAGATCTTCATCATGATCGTGGGCGGCCTGATCGGCCTGCGCATCATCTTCGCCGTGCTGTCGCTG
GTGAACCGCGTGCGCCAGGGCTGATGAGgttaccgaattcgggacctggatccagatctgctgtgccttt
```

>HV1300646

```
gtcgacaagaagccaccATGCGCGTGATGGGCATCCAGCGCAACTACCCGCAGTGGTGGATCTGGTCGATGCTGGGCTTCTGG
ATGCTCATGATCTGCAACGGCATGTGGGTGACGGTGTACTACGGCGTGCCGGTGTGGAAGGAGGCCAAGACGACCCTGTTCTG
CGCGTCGGACGCCAAGGCCTACGAGAAGGAGGTGCACAACGTGTGGGCGACCCACGCCTGCGTGCCCACGGACCCCAACCCGC
AGGAGATGGTGCTGAAGAACGTGACCGAGAACTTCAACATGTGGAAGAACGACATGGTGGACCAGATGCACGAGGACGTGATC
TCCCTGTGGGACCAGTCCCTGAAGCCCTGCGTGAAGCTGACCCCGCTGTGCGTGACCCTGAACTGCACCAACGCGACCAACGC
CACCGCGTCCAACTCCTCCATCATCGAGGGCATGAAGAACTGCTCCTTCAACATCACGACGGAGCTGCGCGACAAGCGCGAGA
AGAAGAACGCCCTGTTCTACAAGCTGGACATCGTGCAGCTGGACGGCAACTCCTCGCAGTACAGGCTGATCAACTGCAACACC
TCCGTCATCACGCAGGCGTGCCCCAAGGTGTCCTTCGACCCCATCCCCATCCACTACTGCGCCCCGCCGGCTACGCCATCCT
GAAGTGCAACAACAAGACCTTCACCGGCACCGGCCCGTGCAACAACGTGTCCACCGTGCAGTGCACGCACGGGATCAAGCCCG
TGGTGTCCACGCAGCTGCTCCTGAACGGGTCGCTGGCCGAGGGCGAGATCATCATCCGGTCCGAGAACATCACGAACAACGAC
AAGACCATCATCGTGCACCTGAACGAGTCCGTGAACATCGAGTGCACCCGCCCGAACAACAAGACGCGCACCTCCATCCGGAT
CGGCCCTGGCCAGGCCTTCTACGCCACCGGCCAGGTGATCGGCGACATCCGCGAGGCGTACTGCAACATCAGCGAGTCCAAGT
GGAACGAGACCCTGCAGCGCGTGTCCAAGAAGCTGAAGGAGTACTTCCCCCACAAGAACATCACCTTCCAGCCGTCGTCCGGC
GGCGACCTCGAGATCACCACGCACTCCTTCAACTGCGGTGGCGAGTTCTTCTACTGCAACACGTCGTCGCTGTTCAACCGCAC
CTACATGGCCAACTCCACCGACATGGCCAACTCCACCGAGACCAACTCCACGCGCAACATCACGATCCACTGCCGCATCAAGC
AGATCATCAACATGTGGCAGGAGGTGGGCCGCGCCATGTACGCACCGCCCATCGCCGGCAACATCACCTGCATCTCCAACATC
ACCGGCCTCCTGCTGACCCGCGACGGCGGCAAGAACGACACGGAGACCTTCAGGCCAGGCGGAGGCAACATGAAGGACAACTG
GCGCTCCGAGCTGTACAAGTACAAGGTGGTGGAGGTGAAGCCCCTGGGCGTGGCACCCACCAACGCCCGCAGGCGCGTCGTGG
AGCGCGAGAAGCGCGCCGTGGGCATGGGCGCCGTGTTCCTGGGCTTCCTGGGCGCTGCGGGCTCCACCATGGGTGCCGCGTCC
ATCACCCTGACCGTGCAGGCCCGCCAGCTGCTCTCCGGCATCGTGCAGCAGCAGTCCAACCTCCTGAAGGCCATCGAGGCCCA
GCAGCACATGCTGAAGCTGACCGTGTGGGGCATCAAGCAGCTGCAGGCCAGGGTGCTCGCGCTCGAGCGCTACCTGAAGGACC
AGCAGCTGCTCGGCATGTGGGGCTGCTCCGGCAAGCTGATCTGCACCACCAACGTGTACTGGAACTCGTCCTGGTCCAACAAG
ACCTACGGCGACATCTGGGACAACATGACCTGGATGCAGTGGGAGCGCGAGATCTCCAACTACACCGAGATCATCTACGAGCT
CCTCGAGGAGTCCCAGAACCAGCAGGAGAAGAACGAGCAGGATCTGCTCGCGCTGGACCGCTGGAACTCCCTGTGGAACTGGT
TCAACATCACCAACTGGCTGTGGTACATCAAGATCTTCATCATGATCGTGGGCGGCCTGATCGGCCTGCGCATCATCTTCGCC
GTGCTGTCGCTGGTGAACCGCGTGCGCCAGGGCTGATGAGaggtcccggtaaccggatccagatctgctgtgccttt
```

>HV1300648

```
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCGACGCCACCGCGTCCAACGCAACGCGAGCAACGCCACGGCGTCGAACT
CCTCCATCATCGAGGAGATGAAGAACTGCTCCTTCAACATCACGACGGAGCTGCGCGACAAGCGCGAGAAGAAGAACGCCCTGTTCTACA
AGCTGGACATCGTGCAGCTGGACGGCAACTCCTCGCAGTACAGGCTGATCAACTGCAACACCTCCGCCATCACGCAGGCGTGCCCCAAGG
TGTCCTTCGACCCCATCCCCATCCACTACTGCGCCCCGCCGGCTACGCCATCCTGAAGTGCAACAACAAGACCTTCAACGGCACCGGCC
CGTGCAACAACGTGTCCACCGTGCAGTGCACGCACGGGATCAAGCCCGTGGTGTCCACGCAGCTGCTCCTGAACGGGTCGCTGGCCGAGG
GCGAGATCATCATCCGGTCCGAGAACATCACGGACAACGGGAAGACCATCATCGTGCACCTGAACGAGTCCGTGAAGATCGAGTGCACCC
```

Fig. 21 cont.
GCCCGTCGAACAACACGCGCACCTCCATCCGGATCGGCCCTGGCCAGGCCTTCTACGCCACCGGCCAGGTGATCGGCGACATCCGCGAGG
CGCACTGCAACATCTCGGAGTCCAAGTGGAACGAGACCCTGCAGCGCGTGTCCAAGAAGCTGAAGGAGTACTTCCCCCACAAGAACATCA
CCTTCCAGCCGTCGTCCGGCGGCGACCTCGAGATCACCACGCACTCCTTCAACTGCGGTGGCGAGTTCTTCTACTGCAACACGTCGTCGC
TGTTCAACCGCACCTACATGGCCAACTCCACCGAGACCAACTCCACGCGCATCATCACGATCCACTGCCGCATCAAGCAGATCATCAACA
TGTGGCAGGAGGTGGGCCGCGCCATGTACGCACCGCCCATCGCCGGCAACATCACCTGCATCTCCAACATCACCGGCCTCCTGCTGACCC
GCGACGGCGGCAACAACAACACGGAGACCTTCAGGCCAGGCGGAGGCAACATGAAGGACAACTGGCGCTCCGAGCTGTACAAGTACAAGG
TGGTGGAGGTGAAGCCCCTGGGCGTGGCACCCACCAACGCCcgcaggcgcgtcgtgggagcgcgagaagcgcGCCGTGGGCATGGGCGCCG
TGTTCCTGGGCTTCCTGGGCGCTGCGGGCTCCACCATGGGTGCCGCGTCCATCACCCTGACCGTGCAGGCCCGCCAGCTGCTCTCCGGCA
TCGTGCAGCAGCAGTCCAACCTCCTGAAGGCCATCGAGGCCCAGCAGCACATGCTGAAGCTGACCGTGTGGGGCATCAAGCAGCTGCAGG
CCAGGGTGCTCGCGCTCGAGCGCTACCTGAAGGACCAGCAGCTGCTCGGCATGTGGGGCTGCTCCGGCAAGCTGATCTGCACCACCAACG
TGTACTGGAACTCGTCCTGGTCCAACAAGACCTACGGCGACATCTGGGACAACATGACCTGGATGCAGTGGGAGCGCGAGATCTCCAACT
ACACCGAGATCATCTACGAGCTCCTCGAGGAGTCCCAGAACCAGCAGGAGAAGAACGAGCAGGATCTGCTCGCGCTGGACCGCTGGAACT
CCCTGTGGAACTGGTTCAACATCACCAACTGGCTGTGGTACATCAAGATCTTCATCATGATCGTGGGCGGCCTGATCGGCCTGCGCATCA
TCTTCGCCGTGCTGTCGCTGGTGAACCGCGTGCGCCAGGGCTGATGAGaattcgggacctggatccagatctgctgtgcctt

>HV1300649 gtcgacaagaagccaccATGCGCGTGATGGGCCGCCAGCGCAACTACCCGCAGTGGTGGATCTGGTCGATGCTGGGCTTCTGG
ATGCTCATGATCTGCAACGGCATGTGGGTGACGGTGTACTACGGCGTGCCGGTGTGGAAGGAGGCCAAGACGACCCTGTTCTG
CGCGTCGGACGCCAAGGCCTACGAGAAGGAGGTGCACAACGTGTGGGCGACCCACGCCTGCGTGCCCACGGACCCCAACCCGC
AGGAGATGGTGCTGAAGAACGTGACCGAGAACTTCAACATGTGGAAGAACGACATGGTGGACCAGATGCACGAGGACGTGATC
TCCCTGTGGGACCAGTCCCTGAAGCCCTGCGTGAAGCTGACCCCGCTGTGCGTGACCCTGAACTGCACCGACGCCACCGCGTC
CAACGCCACGGCGTCGAACTCGTCTATCATCGAGGGGATGAACTCCTCCATCATCGAGGGCATGAAGAACTGCTCCTTCAACA
TCACGACGGAGCTGCGCGACAAGCGCGAGAAGAAGAACGCCCTGTTCTACAAGCTGGACATCGTGCAGCTGGACGGCAACTCC
TCGCAGTACAGGCTGATCAACTGCAACACCTCCGTCATCACGCAGGCGTGCCCCAAGGTGTCCTTCGACCCCATCCCCATCCA
CTACTGCGCCCCCGCCGGCTACGCCATCCTGAAGTGCAACAACAAGACCTTCAACGGCACCGGCCCGTGCAACAACGTGTCCA
CCGTGCAGTGCACGCACGGGATCAAGCCCGTGGTGTCCACGCAGCTGCTCCTGAACGGGTCGCTGGCCGAGGGCGAGATCATC
ATCCGGTCCGAGAACATCACGGACAACGGGAAGACCATCATCGTGCACCTGAACGAGTCCGTGAAGATCGAGTGCACCCGCCC
GTCGAACAACACGCGCACCTCCATCCGGATCGGCCCTGGCCAGGCCTTCTACGCCACCGGCCAGGTGATCGGCGACATCCGCG
AGGCGCACTGCAACATCTCGGAGTCCAAGTGGAACGAGACCCTGCAGCGCGTGTCCGAGAAGCTGAAGGAGTACTTCCCCCAC
AAGAACATCACCTTCCAGCCGTCGTCCGGCGGCGACCTCGAGATCACCACGCACTCCTTCAACTGCGGTGGCGAGTTCTTCTA
CTGCAACACGTCGTCGCTGTTCAACCGCACCTACATGGCCAACTCCACGGACCACGACATGGCCAACTCCACCGAGACCAACTCCACGC
GCATCATCACGATCCGGTGCCGCATCAAGCAGATCATCAACATGTGGCAGGAGGTGGGCCGCGCCATGTACGCACCGCCCATC
GCCGGCAACATCACCTGCATCTCCAACATCACCGGCCTCCTGCTGACCCGCGACGGCGGCAAGAACAACACGGAGACCTTCGA
GACGTTCAGGCCAGGCGGAGGCAACATGAAGGACAACTGGCGCTCCGAGCTGTACAAGTACAAGGTGGTGGAGGTGAAGCCCC
TGGGCGTGGCACCCACCAACGCCCGCAGGCGCGTCGTGGAGCGCGAGAAGCGCGCCGTGGGCATGGGCGCCGTGTTCCTGGGC
TTCCTGGGCGCTGCGGGCTCCACCATGGGTGCCGCGTCCATCACCCTGACCGTGCAGGCCCGCCAGCTGCTCTCCGGCATCGT
GCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGC
ACCACCAACGTGTACTGGAACTCGTCCTGGTCCAACAAGACCTACGGCGACATCTGGGACAACATGACCTGGATGCAGTGGGA
GCGCGAGATCTCCAACTACACCGAGATCATCTACGAGCTCCTCGAGGAGTCCCAGAACCAGCAGGAGAAGAACGAGCAGGATC
TGCTCGCGCTGGACCGCTGGAACTCCCTGTGGAACTGGTTCAACATCACCAACTGGCTGTGGTACATCAAGATCTTCATCATG
ATCGTGGGCGGCCTGATCGGCCTGCGCATCATCTTCGCCGTGCTGTCGCTGGTGAACCGCGTGCGCCAGGGCTGATGAGaatt
cggttaccgggacccggatccagatctgctgtgcctt

>HV1300650 gtcgacaagaagccaccATGCGCGTGATGGGCATCCAGCGCAACTACCCGCAGTGGTGGATCTGGTCGATGCTGGGCTTCTGG
ATGCTCATGATCTGCAACGGCATGTGGGTGACGGTGTACTACGGCGTGCCGGTGTGGAAGGAGGCCAAGACGACCCTGTTCTG
CGCGTCGGACGCCAAGGCCTACGAGAAGGAGGTGCACAACGTGTGGGCGACCCACGCCTGCGTGCCCACGGACCCCAACCCGC
AGGAGATGGTGCTGAAGAACGTGACCGAGAACTTCAACATGTGGAAGAACGACATGGTGGACCAGATGCACGAGGACGTGATC
TCCCTGTGGGACCAGTCCCTGAAGCCCTGCGTGAGGCTGACCCCGCTGTGCGTGACCCTGAACTGCATCAACGCCACCAACGC
AACCGCGTCCAACAACTCCATCCTCGAGGGCATGAAGAACTGCTCCTTCAACATCGCGACGGAGCTGCGCGACAAGCGCGAGA
AGAAGAACGCCCTGTTCTACAAGCTGGACATCGTGCAGCTGGACGGCAACTCCTCGCAGTACAGGCTGATCAACTGCAACACC
TCCGTCATCACGCAGGCGTGCCCCAAGGTGTCCTTCGACCCCATCCCCATCCACTACTGCGCCCCCGCCGGCTACGCCATCCT
GAAGTGCAACAACAAGACCTTCAACGGCACCGGCCCGTGCAACAACGTGTCCACCGTGCAGTGCACGCACGGGATCAAGCCCG
TGGTGTCCACGCAGCTGCTCCTGAACGGGTCGCTGGCCGAGGGCGAGATCATCATCCGGTCGAAGAACATCACCGACAACGGG
AAGACCATCATCGTGCACCTGAACGAGTCCGTGAAGATCGAGTGCACCCGCCCGTCGAACAACACGCGCACCTCCATCCGGAT
CGGCCCTGGCCAGGCCTTCTACGCCACCGGCCAGGTGATCGGCAACATCCGCGAGGCGCACTGCAACATCTCGGAGTCCAAGT
GGAACGAGACCCTGCAGCGCGTGTCCAAGAAGCTGAAGGAGTACTTCCCCGACAAGAACATCACGTTCCAGCCGTCGTCCGGC

Fig. 21 cont.
GGCGACCTCGAGATCACCACGCACTCCTTCAGCTGCGGTGGCGAGTTCTTCTACTGCAACACGTCGTCGCTGTTCAACCGCAC
CTACATGGCCACGAACACCGACATGGCCAACTCCACCGAGACCAACTCCACGCGCATCATCACGATCCGCTGCCGCATCCGGC
AGATCATCAACATGTGGCAGGAGGTGGGCCGCGCCATGTACGCACCGCCCATCGCCGGCAACATCACCTGCATCTCCAACATC
ACCGGCCTCCTGCTGACCCGCGACGGCGGCGAGAACAACACGGAGACCTTCGAGACGTTCAGGCCAGGCGGAGGCAACATGAA
GGACAACTGGCGCTCCGAGCTGTACAAGTACAAGGTGGTGGAGGTGAAGCCCCTGGGCGTGGCACCCACCAACGCCCGCAGGC
GCGTCGTGGAGCGCGAGAAGCGCGCCGTGGGCATGGGCGCCGTGTTCCTGGGCTTCCTGGGCGCTGCGGGCTCCACCATGGGT
GCCGCGTCCATCACCCTGACCGTGCAGGCCCGCCAGCTGCTCTCCGGCATCGTGCAGCAGCAGTCCAACCTCCTGAAGGCCAT
CGAGGCCCAGCAGCACATGCTGAAGCTGACCGTGTGGGGCATCAAGCAGCTGCAGGCCAGGGTGCTCGCGCTCGAGCGCTACC
TGAAGGACCAGCAGCTGCTCGGCATGTGGGGCTGCTCCGGCAAGCTGATCTGCACCACCAACGTGTACTGGAACTCGTCCTGG
TCCAACAAGACCTACGGCGACATCTGGGACAACATGACCTGGATGCAGTGGGAGCGCGAGATCTCCAACTACACCGAGCTCAT
CTACGAGCTCCTCGAGGAGTCCCAGAACCAGCAGGAGAAGAACGAGCAGGATCTGCTCGCGCTGGACCGCTGGAACTCCCTGT
GGAACTGGTTCAACATCACCAACTGGCTGTGGTACATCAAGATCTTCATCATGATCGTGGGCGGCCTGATCGGCCTGCGCATC
ATCTTCGCCGTGCTGTCGCTGGTGAACCGCGTGCGCCAGGGCTGATGAGaattcggtgaccgggtcctggatccagatctgct
gtgcctt >HV1300656
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAAGAACGTGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
GAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgtgaccgaattcgggacccggatccagatctgctgtgcctt
>HV1300657
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGCGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA

Fig. 21 cont.

```
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgtcaccgaattcgggacccggatccagatctgctgtgcctt
>HV1300658
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCGAAGAACATCA
CGGACAACTCGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCACTGCCGCATCAAGCAGATCATCAACATGTGGCAGGAGG
TGGGCCGCGCCATGTACGCACCGCCCATCGCCGAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgtaaccgaattcgggacccggatccagatctgctgtgcctt
>HV1300659
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACTCGGCGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCACTGCCGCATCAAGCAGATCATCAACATGTGGCAGGAGG
TGGGCCGCGCCATGTACGCACCGCCCATCGCCGAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
```

Fig. 21 cont.
```
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgttaccgaattcgggacccggatccagatctgctgtgccttt
>HV1300660
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCGAAGAACATCA
CGGACAACGGGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACAGCAGGAGAAGAACGAGCAGGATCTGCTCGCGCTGGACCGCTGGAACTCCCTGTGGAACT
GGTTCAACATCACCAACTGGCTGTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgtgaccgaattcgggtcccggatccagatctgctgtgccttt
>HV1300661
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGGGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgtgaccgaattcaggacccggatccagatctgctgtgccttt
>HV1300662
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
```

Fig. 21 cont.
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGGACAACGGGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgtgaccgaattcaggtcccggatccagatctgctgtgccctt >HV1300663
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGACAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgtgaccgaattcgggacctggatccagatctgctgtgccctt
>HV1300664
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACTCGGGGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA

Fig. 21 cont.
```
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgtgaccgaattcgggtcctggatccagatctgctgtgccttt
>HV1300665
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAAGACGTGAAGACCATCATCGTGCACCTGAACGAGTCCGTGAAGATCGAGTGCACCCGCCCGAACAACAAGACGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgtcaccgaattcgggtcccggatccagatctgctgtgccttt
>HV1300666
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAAGACGTGAAGACCATCATCGTGCACCTGAACGAGTCCGTGAAGATCGAGTGCACCCGCCCGAACAACAAGACGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
```

Fig. 21 cont.
```
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgtcaccgaattcgggacctggatccagatctgctgtgccttt
>HV1300667
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGTGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCGCTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgtcaccgaattcgggtcctggatccagatctgctgtgccttt
>HV1300668
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCATCACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGGGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgtaaccgaattcaggtcccggatccagatctgctgtgccttt
>HV1300669
```

Fig. 21 cont.
```
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGTGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCAAGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgtaaccgaattcgggtcctggatccagatctgctgtgcctt
>HV1300670
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACACGAACGCCACGGCCTCGAACTCCTCCACGA
TCGAGGGCATGAAGAACTGCTCCTTCAACATCACGACGGAGCTGCGCGACAAGCGCGAGAAGAAGAACGCCCTGTTCTACAAGCTGGACA
TCGTGCAGCTGGACGGCAACTCCTCGCAGTACAGGCTGATCAACTGCAACACCTCCGTCATCACGCAGGCGTGCCCCAAGGTGTCCTTCG
ACCCCATCCCCATCCACTACTGCGCCCCCGCCGGCTACGCCATCCTGAAGTGCAACAACAAGACCTTCACCGGCACCGGCCCGTGCAACA
ACGTGTCCACCGTGCAGTGCACACGGGATCAAGCCCGTGGTGTCCACGCAGCTGCTCCTGAACGGGTCGCTGGCCGAGGGCGAGATCA
TCATCCGGTCCGAGAACATCACGAACAACGTGAAGACCATCATCGTGCACCTGAACGAGTCCGTGAAGATCGAGTGCACCCGCCCGAACA
ACAAGACGCGCACCTCCATCCGGATCGGCCCTGGCCAGGCCTTCTACGCCACCGGCCAGGTGATCGGCAACATCCGCGAGGCGTACTGCA
ACATCTCGGAGTCCAAGTGGAACGAGACCCTGCAGCGCGTGTCCAAGAAGCTGAAGGAGTACTTCCCCCACAAGAACATCACCTTCCAGC
CGTCGTCCGGCGGCGACCTCGAGATCACCACGCACTCCTTCAACTGCGGTGGCGAGTTCTTCTACTGCAACACGTCGTCGCTGTTCAACC
GCACCTACATGGCCAACTCCACCGACATGGCCAACTCCACCGAGACCAACTCCACGCGCATCATCACGATCCACTGCCGCATCAAGCAGA
TCATCAACATGTGGCAGGAGGTGGGCCGCGCCATGTACGCACCGCCCATCGCCGGCAACATCACCTGCATCTCCAACATCACCGGCCTCC
TGCTGACCCGCGACGGCGGCAAGAACAACACGGAGACCTTCAGGCCAGGCGGAGGCAACATGAAGGACAACTGGCGCTCCGAGCTGTACA
AGTACAAGGTGGTGGAGGTGAAGCCCCTGGGCGTGGCACCCACCAACGCCCGCAGGCGCGTCGTGGAGCGCGAGAAGCGCGCCGTGGGCA
TGGGCGCCGTGTTCCTGGGCTTCCTGGGCGCTGCGGGCTCCACCATGGGTGCCGCGTCCATCACCCTGACCGTGCAGGCCCGCCAGCTGC
TCTCCGGCATCGTGCAGCAGCAGTCCAACCTCCTGAAGGCCATCGAGGCCCAGCAGCACATGCTGAAGCTGACCGTGTGGGGCATCAAGC
AGCTGCAGGCCAGGGTGCTCGCGCTCGAGCGCTACCTGAAGGACCAGCAGCTGCTCGGCATGTGGGGCTGCTCCGGCAAGCTGATCTGCA
CCACCAACGTGTACTGGAACTCGTCCTGGTCCAACAAGACCTACGGCGACATCTGGGACAACATGACCTGGATTCAGTGGGAGCGCGAGA
TCTCCAACTACACCGAGATCATCTACGAGCTCCTCGAGGAGTCCCAGAACCAGCAGGAGAAGAACGAGCAGGATCTGCTCGCGCTGGACC
GCTGGAACTCCCTGTGGAACTGGTTCAACATCACCAACTGGCTGTGGTACATCAAGATCTTCATCATGATCGTGGGCGGCCTGATCGGCC
TGCGCATCATCTTCGCCGTGCTGTCGCTGGCGAACCGCGTGCGCCAGGGCTGATGAGgttaccgaattcgggtcccggatccagatctgc
tgtgcctt
>HV1300671
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGAACAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
```

Fig. 21 cont.
```
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGGGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCTCGGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCGCTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgtcaccgaattcaggacccggatccagatctgctgtgccttt
>HV1300672
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGAACAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGCGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCAACATCCGCGAGGCGTACTGCAACATCTCGGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGCTCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgttaccgaattcaggtcccggatccagatctgctgtgccttt
>HV1300673
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCACGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGTGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCCGGAACATCCGCGAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
```

Fig. 21 cont.
```
CCGACATGGCCAACTCCACCGAGACCAACTCCACGCGCACCATCAAGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACCTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGgttaccgaattcgggtcctggatccagatctgctgtgccctt
>HV1300674
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCACGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGTGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCTCGGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACAACACGCGCACCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACCTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGggacccgaattcggtaaccggatccagatctgctgtgccctt
>HV1300675
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACGCCACGGCCTCGAACTCCTCCATCATCGAGG
GCATGAAGAACTGCTCCTTCAACATCACGACGGAGCTGCGCGACAAGCGCGAGAAGAAGAACGCCCTGTTCTACAAGCTGGACATCGTGC
AGCTGGACGGCAACTCCTCGCAGTACAGGCTGATCAACTGCAACACCTCCGTCATCACGCAGGCGTGCCCCAAGGTGTCCTTCGACCCCA
TCCCCATCCACTACTGCGCCCCCGCCGGCTACGCCATCCTGAAGTGCAACAACAAGACCTTCACCGGCACCGGCCCGTGCAACAACGTGT
CCACCGTGCAGTGCACGCACGGCATCAAGCCCGTGGTGTCCACGCAGCTGCTCCTGAACGGGTCGCTGGCCGAGGGCGAGATCATCATCC
GGTCCGAGAACATCACGAACAACGTGAAGACCATCATCGTGCACCTGAACGAGTCCGTGAAGATCGAGTGCACCCGCCCGAACAACAAGA
CGCGCAAGTCCATCCGGATCGGCCCTGGCCAGGCCTTCTACGCCACCGGCCAGGTGATCGGCGACATCCGCGAGGCGTACTGCAACATCT
CCGAGTCCAAGTGGAACGAGACCCTGCAGCGCGTGTCCAAGAAGCTGAAGGAGTACTTCCCCCACAAGAACATCACCTTCCAGCCGTCGT
CCGGCGGCGACCTCGAGATCACCACGCACTCCTTCAACTGCGGTGGCGAGTTCTTCTACTGCAACACGTCGTCGCTGTTCAACCGCACCT
ACATGGCCAACTCCACCGACATGGCCAACTCCACCGAGACCAACTCCACGCGCACCATCACGATCCGCTGCCGCATCAAGCAGATCATCA
ACATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAAGAACAACACGGAGACCTTCAGGCCAGGCGGAGGCAACATGAAGGACAACTGGCGCTCCGAGCTGTACAAGTACA
AGGTGGTGGAGGTGAAGCCCCTGGGCGTGGCACCCACCAACGCCCGCAGGCGCGTCGTGGAGCGCGAGAAGCGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
```

Fig. 21 cont.

ACGTGTACTGGAACTCGTCCTGGTCCAACAAGACCTACGGCGACATCTGGGACAACATGACCTGGATGCAGTGGGAGCGCGAGATCTCCA
ACTACACCGAGATCATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACCGCGTGCGCCAGGGCTGATGAGggacccgaattcggttaccggatccagatctgctgtgcc
tt
>HV1300676
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCACGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGTGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCGAGGCGTACTGCAACATCTCGGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCGCTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGggtcccgaattcggtgaccggatccagatctgctgtgccttt
>HV1300677
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCACGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGCGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCAAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACAACACGCGCACCATCACGATCCGCTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGGCTGATGAGaggacccgaattcggtgaccggatccagatctgctgtgccttt
>HV1300678

Fig. 21 cont.
```
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCACGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGCGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCAAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGCTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCACCATCACGATCCGCTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGaggtcccgaattcggtgaccggatccagatctgctgtgccttt
>HV1300679
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCGACGGCCAACGCCACCGCGTCCAACTCCTCCATCATCGAGGGCA
TGAAGAACTGCTCCTTCAACATCACGACGGAGCTGCGCGACAAGCGCGAGAAGAAGAACGCCCTGTTCTACAAGCTGGACATCGTGCAGC
TGGACGGCAACTCCTCGCAGTACAGGCTGATCAACTGCAACACCTCCGTCATCACGCAGGCGTGCCCCAAGGTGTCCTTCGACCCCATCC
CCATCCACTACTGCGCCCCGCCGGCTACGCCATCCTGAAGTGCAACAACAAGACCTTCACCGGCACCGGCCCGTGCAACAACGTGTCCA
CCGTGCAGTGCACGCACGGGATCAAGCCCGTGGTGTCCACGCAGCTGCTCCTGAACGGGTCGCTGGCCGAGGGCGAGATCATCATCCGGT
CCGAGAACATCACGAACAACGGGAAGACCATCATCGTCCAGCTCAACGAGTCCGTGAAGATCGAGTGCACCCGCCCGAACAACAAGACGC
GCACCTCCATCCGGATCGGCCCTGGCCAGGCCTTCTACGCCACCGGCCAGGTGATCGGCGACATCCGCAAGGCGTACTGCAACATCAGCG
AGTCCAAGTGGAACGAGACCCTGCAGCGCGTGTCCAAGAAGCTGAAGGAGTACTTCCCCCACAAGAACATCACCTTCCAGCCGTCGTCCG
GCGGCGACCTCGAGATCACCACGCACTCCTTCAACTGCGGTGGCGAGTTCTTCTACTGCAACACGTCGTCGCTGTTCAACCGCACCTACA
TGGCCAACTCCACCGACATGGCCAACTCCACCGAGACCAACTCCACGCGCATCATCACGATCCACTGCCGCATCAAGCAGATCATCAACA
TGTGGCAGGAGGTGGGCCGCGCCATGTACGCACCGCCCATCGCCGGCAACATCACCTGCATCTCCAACATCACCGGCCTCCTGCTGACCC
GCGACGGCGGCAAGAACAACACCGACACGGAGACCTTCAGGCCAGGCGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTCGTGGAGCGCGAGAAGCGCGCCGTGGGCATGG
GCGCCGTGTTCCTGGGCTTCCTGGGCGCTGCGGGCTCCACCATGGGTGCCGCGTCCATCACCCTGACCGTGCAGGCCCGCCAGCTGCTCT
CCGGCATCGTGCAGCAGCAGTCCAACCTCCTGAAGGCCATCGAGGCCCAGCAGCACATGCTGAAGCTGACCGTGTGGGGCATCAAGCAGC
TGCAGGCCAGGGTGCTCGCGCTCGAGCGCTACCTGAAGGACCAGCAGCTGCTCGGCATGTGGGGCTGCTCCGGCAAGCTGATCTGCACCA
CCAACGTGTACTGGAACTCGTCCTGGTCCAACAAGACCTACGGCGACATCTGGGACAACATGACCTGGATGCAGTGGGAGCGCGAGATCT
CCAACTACACCGAGATCATCTACGAGCTCCTCGAGGAGTCCCAGAACCAGCAGGAGAAGAACGAGCAGGATCTGCTCGCGCTGGACCGCT
GGAACTCCCTGTGGAACTGGTTCAACATCACCAACTGGCTGTGGTACATCAAGATCTTCATCATGATCGTGGGCGGCCTGATCGGCCTGC
GCATCATCTTCGCCGTGCTGTCGCTGGTGAACCGCGTGCGCCAGGGCTGATGAGggtcctgaattcggtgaccggatccagatctgctgt
gccttt
>HV1300680
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCGACGACCAACGCCACCGCGTCCAACTCCTCCATCATCGAGGGCA
TGAAGAACTGCTCCTTCAACATCACGACGGAGCTGCGCGACAAGCGCGAGAAGAAGAACGCCCTGTTCTACAAGCTGGACATCGTGCAGC
```

Fig. 21 cont.
TGGACGGCAACTCCTCGCAGTACAGGCTGATCAACTGCAACACCTCCGTCATCACGCAGGCGTGCCCCAAGGTGTCCTTCGACCCCATCC
CCATCCACTACTGCGCCCCGCCGGCTACGCCATCCTGAAGTGCAACAACAAGACCTTCACCGGCACCGGCCCGTGCAACAACGTGTCCA
CCGTGCAGTGCACGCACGGGATCAAGCCCGTGGTGTCCACGCAGCTGCTCCTGAACGGGTCGCTGGCCGAGGGCGAGATCATCATCCGGT
CCGAGAACATCACGAACAACGCGAAGACCATCATCGTGCACCTGAACGAGTCCGTGAAGATCGAGTGCACCCGCCCGAGCAACAAGACGC
GCACCTCCATCCGGATCGGCCCTGGCCAGGCCTTCTACGCCACCGGCCAGGTGATCGGCGACATCCGCGAGGCGTACTGCAACATCAGCG
AGTCCAAGTGGAACGAGACCCTGCAGCGCGTGTCCAAGAAGCTGAAGGAGTACTTCCCCCACAAGAACATCACCTTCCAGCCGTCGTCCG
GCGGCGACCTCGAGATCACCACGCACTCCTTCAACTGCGGTGGCGAGTTCTTCTACTGCAACACGTCGTCGCTGTTCAACCGCACCTACA
TGGCCAACTCCACCGACATGGCCAACTCCACCGAGACCAACTCCACGCGCACCATCACGATCCGGTGCCGCATCAAGCAGATCATCAACA
TGTGGCAGGAGGTGGGCCGCGCCATGTACGCACCGCCCATCGCCGGCAACATCACCTGCATCTCCAACATCACCGGCCTCCTGCTGACCC
GCGACGGCGGCAAGAACAACACGGACGCAGGAGACCTTCAGGCCAGGCGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTCGTGGAGCGCGAGAAGCGCGCCGTGGGCATGG
GCGCCGTGTTCCTGGGCTTCCTGGGCGCTGCGGGCTCCACCATGGGTGCCGCGTCCATCACCCTGACCGTGCAGGCCCGCCAGCTGCTCT
CCGGCATCGTGCAGCAGCAGTCCAACCTCCTGAAGGCCATCGAGGCCCAGCAGCACATGCTGAAGCTGACCGTGTGGGGCATCAAGCAGC
TGCAGGCCAGGGTGCTCGCGCTCGAGCGCTACCTGAAGGACCAGCAGCTGCTCGGCATGTGGGGCTGCTCCGGCAAGCTGATCTGCACCA
CCAACGTGTACTGGAACTCGTCCTGGTCCAACAAGACCTACGGCGACATCTGGGACAACATGACCTGGATGCAGTGGGAGCGCGAGATCT
CCAACTACACCGAGATCATCTACGAGCTCCTCGAGGAGTCCCAGAACCAGCAGGAGAAGAACGAGCAGGATCTGCTCGCGCTGGACCGCT
GGAACTCCCTGTGGAACTGGTTCAACATCACCAACTGGCTGTGGTACATCAAGGTGTTCATCATGATCGTGGGCGGCCTGATCGGCCTGC
GCATCATCTTCGCCGTGCTGTCGCTGGTGAACCGCGTGCGCCAGGGCTGATGAGggtcccgaattcggtcaccggatccagatctgctgt
gcctt
>HV1300681
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCGACGGCGAACGCCACCGCGTCCAACTCCTCCATCATCGAGGGCA
TGAAGAACTGCTCCTTCAACATCACGACGGAGCTGCGCGACAAGCGCGAGAAGAAGAACGCCCTGTTCTACAAGCTGGACATCGTGCAGC
TGGACGGCAACTCCTCGCAGTACAGGCTGATCAACTGCAACACCTCCGTCATCACGCAGGCGTGCCCCAAGGTGTCCTTCGACCCCATCC
CCATCCACTACTGCGCCCCGCCGGCTACGCCATCCTGAAGTGCAACAACAAGACCTTCAACGGCACCGGCCCGTGCAACAACGTGTCCA
CCGTGCAGTGCACGCACGGGATCAAGCCCGTGGTGTCCACGCAGCTGCTCCTGAACGGGTCGCTGGCCGAGGGCGAGATCATCATCCGGT
CCGAGAACATCACGAACAACGTGAAGACCATCATCGTGCACCTGAACGAGTCCGTGAAGATCGAGTGCACCCGCCCGAACAACAAGACGC
GCACCTCCATCCGGATCGGCCCTGGCCAGGCCTTCTACGCCACCGGCCAGGTGATCGGCGACATCCGCGAGGCGCACTGCAACATCAGCG
AGTCCAAGTGGAACGAGACCCTGCAGCGCGTGTCCAAGAAGCTGAAGGAGTACTTCCCCCACAAGAACATCACCTTCCAGCCGTCGTCCG
GCGGCGACCTCGAGATCACCACGCACTCCTTCAACTGCGGTGGCGAGTTCTTCTACTGCAACACGTCGTCGCTGTTCAACCGCACCTACA
TGGCCAACTCCACCGACATGGCCAACTCCACCGAGACCAACTCCACGCGCACCATCACGATCCGGTGCCGCATCAAGCAGATCATCAACA
TGTGGCAGGAGGTGGGCCGCGCCATGTACGCACCGCCCATCGCCGGCAACATCACCTGCATCTCCAACATCACCGGCCTCCTGCTGACCC
GCGACGGCGGCAAGAACAACACCGACACGGAGACCTTCAGGCCAGGCGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTCGTGGAGCGCGAGAAGCGCGCCGTGGGCATGG
GCGCCGTGTTCCTGGGCTTCCTGGGCGCTGCGGGCTCCACCATGGGTGCCGCGTCCATCACCCTGACCGTGCAGGCCCGCCAGCTGCTCT
CCGGCATCGTGCAGCAGCAGTCCAACCTCCTGAAGGCCATCGAGGCCCAGCAGCACATGCTGAAGCTGACCGTGTGGGGCATCAAGCAGC
TGCAGGCCAGGGTGCTCGCGCTCGAGCGCTACCTGAAGGACCAGCAGCTGCTCGGCATGTGGGGCTGCTCCGGCAAGCTGATCTGCACCA
CCAACGTGTACTGGAACTCGTCCTGGTCCAACAAGACCTACGGCGACATCTGGGACAACATGACCTGGATGCAGTGGGAGCGCGAGATCT
CCAACTACACCGAGATCATCTACGAGCTCCTCGAGGAGTCCCAGAACCAGCAGGAGAAGAACGAGCAGGATCTGCTCGCGCTGGACCGCT
GGAACTCCCTGTGGAACTGGTTCAACATCACCAACTGGCTGTGGTACATCAAGGATCTTCATCATGATCGTGGGCGGCCTGATCGGCCTGC
GCATCATCTTCGCCGTGCTGTCGCTGGTGAACCGCGTGCGCCAGGGCTGATGAGaggacccgaattcggtcaccggatccagatctgctg
tgcctt
>HV1300682
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCACGTCCAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCCGAGAACATCA
CGAACAACGACAAGACCATCATCGTGCACCTGAACGAGTCCGTGAAGATCGAGTGCACCCGCCCGAACAACAACACGCGCACCTCCATCC
GGATCGGCCCTGGCCAGGCCTTCTACGCCACCGGCCAGGTGATCGGCGACATCCGCGAGGCGTACTGCAACATCTCGGAGTCCAAGTGGA

Fig. 21 cont.

ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCTACATGGCCAACTCCA
CCGACATGGCCAACTCCACCGAGACCAACTCCACGCGCATCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
AGAACAACACGGAGACCTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGaggtcccgaattcggtcaccggatccagatctgctgtgcctt
>HV1300683
gtcgacaagaagccaccATGCGCGTGATGGGCATCCAGCGCAACTACCCGCAGTGGTGGATCTGGTCGATGCTGGGCTTCTGGATGCTCA
TGATCTGCAAGGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACATCTCCATCGAGGAGATGAAGAACTGCTCCT
TCAACATCACGACGGAGCTGCGCGACAAGCGCGAGAAGAAGAACGCCCTGTTCTACAAGCTGGACATCGTGCAGCTGGACGGCAACTCCT
CGCAGTACAGGCTGATCAACTGCAACACCTCCGTCATCACGCAGGCGTGCCCCAAGGTGTCCTTCGACCCCATCCCCATCCACTACTGCG
CCCCCGCCGGCTACGCCATCCTGAAGTGCAACAACAAGACCTTCACCGGCACCGGCCCGTGCAACAACGTGTCCACCGTGCAGTGCACGC
ACGGGATCAAGCCCGTGGTGTCCACGCAGCTGCTCCTGAACGGGTCGCTGGCCGAGGGCGAGATCATCATCCGGTCCGAGAACATCACGG
ACAACGTGAAGACCATCATCGTGCACCTGAACGAGTCCGTGAAGATCGAGTGCACCCGCCCGAACAACAAGACGCGCACCTCCATCCGGA
TCGGCCCTGGCCAGGCCTTCTACGCCACCGGCCAGGTGATCGGCGACATCCGCGAGGCGTACTGCAACATCTCGGAGTCCAAGTGGAACG
AGACCCTGCAGCGCGTGTCCAAGAAGCTGAAGGAGTACTTCCCCCACAAGAACATCACCTTCCAGCCGTCGTCCGGCGGCGACCTCGAGA
TCACCACGCACTCCTTCAACTGCGGTGGCGAGTTCTTCTACTGCAACACGTCGTCGCTGTTCAACCGCACCTACATGGCCAACAACTCCA
CCGAGACCAACTCCACGCGCACCATCACGATCCGGTGCCGCATCAAGCAGATCATCAACATGTGGCAGGAGGTGGGCCGCGCCATGTACG
CACCGCCCATCGCCGGCAACATCACCTGCATCTCCAACATCACCGGCCTCCTGCTGACCCGCGACGGCGGCAAGAACAACACCGACACGG
AGACCTTCAGGCCAGGCGGAGGCAACATGAAGGACAACTGGCGCTCCGAGCTGTACAAGTACAAGGTGGTGGAGGTGAAGCCCCTGGGCG
TGGCACCCACCAACGCCCGCAGGCGCGTCGTGGAGCGCGAGAAGCGCGCCGTGGGCATGGGCGCCGTGTTCCTGGGCTTCCTGGGCGCTG
CGGGCTCCACCATGGGTGCCGCGTCCATCACCCTGACCGTGCAGGCCCGCCAGCTGCTCTCCGGCATCGTGCAGCAGCAGTCCAACCTCC
TGAAGGCCATCGAGGCCCAGCAGCACATGCTGAAGCTGACCGTGTGGGGCATCAAGCAGCTGCAGGCCAGGGTGCTCGCGCTCGAGCGCT
ACCTGAAGGACCAGCAGCTGCTCGGCATGTGGGGCTGCTCCGGCAAGCTGATCTGCACCACCAACGTGTACTGGAACTCGTCCTGGTCCA
ACAAGACCTACGGCGACATCTGGGACAACATGACCTGGATGCAGTGGGAGCGCGAGATCTCCAACTACACCGAGATCATCTACGAGCTCC
TCGAGGAGTCCCAGAACCAGCAGGAGAAGAACGAGCAGGATCTGCTCGCGCTGGACCGCTGGAACTCCCTGTGGAACTGGTTCAACATCA
CCAACTGGCTGTGGTACATCAAGATCTTCATCATGATCGTGGGCGGCCTGATCGGCCTGCGCATCATCTTCGCCGTGCTGTCGCTGGTGA
ACCGCGTGCGCCAGGGCTGATGAGggacctgaattcggtcaccggatccagatctgctgtgcctt
>HV1300684
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGTCCAACATCTCCATCGAGG
GCATGAAGAACTGCTCCTTCAACATCACGACGGAGCTGCGCGACAAGCGCGAGAAGAAGAACGCCCTGTTCTACAAGCTGGACATCGTGC
AGCTGGACGGCAACTCCTCGCAGTACAGGCTGATCAACTGCAACACCTCCGTCATCACGCAGGCGTGCCCCAAGGTGTCCTTCGACCCCA
TCCCCATCCACTACTGCGCCCCCGCCGGCTACGCCATCCTGAAGTGCAACAACAAGACCTTCACCGGCACCGGCCCGTGCAACAACGTGT
CCACCGTGCAGTGCACGCACGGGATCAAGCCCGTGGTGTCCACGCAGCTGCTCCTGAACGGGTCGCTGGCCGAGGGCGAGATCATCATCC
GGTCCGAGAACATCACGAACAACGTGAAGACCATCATCGTGCACCTGAACGAGTCCGTGAAGATCGAGTGCACCCGCCCGAACAACAAGA
CGCGCAAGTCCATCCGGATCGGCCCTGGCCAGGCCTTCTACGCCACCGGCCAGGTGATCGGCGACATCCGCGAGGCGTACTGCAACATCA
ACGAGTCCAAGTGGAACGAGACCCTGCAGCGCGTGTCCAAGAAGCTGAAGGAGTACTTCCCCCACAAGAACATCACCTTCCAGCCGTCGT
CCGGCGGCGACCTCGAGATCACCACGCACTCCTTCAACTGCGGTGGCGAGTTCTTCTACTGCAACACGTCGTCGCTGTTCAACCGCACCT
ACATGGCCAACTCCACCGACATGGCCAACTCCACCGAGACCAACTCCACGCGCACCATCACGATCCGCTGCCGCATCAAGCAGATCATCA
ACATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAAGAACAACGGAGACCTTCAGGCCAGGCGGAGGCAACATGAAGGACAACTGGCGCTCCGAGCTGTACAAGTACA
AGGTGGTGGAGGTGAAGCCCCTGGGCGTGGCACCCACCAACGCCCGCAGGCGCGTCGTGGAGCGCGAGAAGCGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG

Fig. 21 cont.
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
ACGTGTACTGGAACTCGTCCTGGTCCAACAAGACCTACGGCGACATCTGGGACAACATGACCTGGATGCAGTGGGAGCGCGAGATCTCCA
ACTACACCGAGATCATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACCGCGTGCGCCAGGGCTGATGAGggacccgaattcggtgaccggatccagatctgctgtgcc
tt
>HV1300685
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGGGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCGACGGCCTCCAACGCCACCGCGTCCAACTCCTCCATCATCGAGG
GCATGAAGAACTGCTCCTTCAACATCACGACGGAGCTGCGCGACAAGCGCGAGAAGAAGAACGCCCTGTTCTACAAGCTGGACATCGTGC
AGCTGGACGGCAACTCCTCGCAGTACAGGCTGATCAACTGCAACACCTCCGTCATCACGCAGGCGTGCCCCAAGGTGTCCTTCGACCCCA
TCCCCATCCACTACTGCGCCCCCGCCGGCTACGCCATCCTGAAGTGCAACAACAAGACCTTCACCGGCACCGGCCCGTGCAACAACGTGT
CCACCGTGCAGTGCACGCACGGGATCAAGCCCGTGGTGTCCACGCAGCTGCTCCTGAACGGGTCGCTGGCCGAGGGCGAGATCATCATCC
GGTCCGAGAACATCACGAACAACGGGAAGACCATCATCGTGCACCTGAACGAGTCCGTGAAGATCGAGTGCACCCGCCCGAACAACAAGA
CGCGCACCTCCATCCGGATCGGCCCTGGCCAGGCCTTCTACGCCACCGGCCAGGTGATCGGCGACATCCGCGAGGCGCACTGCAACATCA
GCGAGTCCAAGTGGAACGAGACCCTGCAGCGCGTGTCCAAGAAGCTGAAGGAGTACTTCCCCCACCAGAACATCACCTTCCAGCCGTCGT
CCGGCGGCGACCTCGAGATCACCACGCACTCCTTCAACTGCGGTGGCGAGTTCTTCTACTGCAACACGTCGTCGCTGTTCAACCGCACCT
ACATGGCCAACTCCACCGACATGGCCAACTCCACCGAGACCAACTCCACGCGCACCATCACGATCCGCTGCCGCATCAAGCAGATCATCA
ACATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAAGAACAACACGGACACGGAGACCTTCAGGCCAGGCGGAGGCAACATGAAGGACAACTGGCGCTCCGAGCTGTACA
AGTACAAGGTGGTGGAGGTGAAGCCCCTGGGCGTGGCACCCACCAACGCCCGCAGGCGCGTCGTGGAGCGCGAGAAGCGCGCCGTGGGCA
TGGGCGCCGTGTTCCTGGGCTTCCTGGGCGCTGCGGGCTCCACCATGGGTGCCGCGTCCATCACCCTGACCGTGCAGGCCCGCCAGCTGC
TCTCCGGCATCGTGCAGCAGCAGTCCAACCTCCTGAAGGCCATCGAGGCCCAGCAGCACATGCTGAAGCTGACCGTGTGGGGCATCAAGC
AGCTGCAGGCCAGGGTGCTCGCGCTCGAGCGCTACCTGAAGGACCAGCAGCTGCTCGGCATGTGGGGCTGCTCCGGCAAGCTGATCTGCA
CCACCAACGTGTACTGGAACTCGTCCTGGTCCAACAAGACCTACGGCGACATCTGGGACAACATGACCTGGATGCAGTGGGAGCGCGAGA
TCTCCAACTACACCGAGATCATCTACGAGCTCCTCGAGGAGTCCCAGAACCAGCAGGAGAAGAACGAGCAGGATCTGCTCGCGCTGGACC
GCTGGAACTCCCTGTGGAACTGGTTCAACATCACCAACTGGCTGTGGTACATCAAGATCTTCATCATGATCGTGGGCGGCCTGATCGGCC
TGCGCATCATCTTCGCCGTGCTGTCGCTGGTGAACCGCGTGCGCCAGGGCTGATGAGggtcccgaattcggtaaccggatccagatctgc
tgtgccctt
>HV1300686
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCGACGAACGCCACCGCGTCCAACTCCTCCATCATCGAGGGCATGA
AGAACTGCTCCTTCAACATCACGACGGAGCTGCGCGACAAGCGCGAGAAGAAGAACGCCCTGTTCTACAAGCTGGACATCGTGCAGCTGG
ACGGCAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCCGCCGGCTACGCCATCCTGAAGTGCAACAACAAGACCTTCACCGGCACCGGCAGCTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCCG
AGAACATCACGGACAACGGGAAGACCATCATCGTGCACCTGAACGAGTCCGTGAAGATCGAGTGCACCCGCCCGAACAACAAGACGCGCA
CCTCCATCCGGATCGGCCCTGGCCAGGCCTTCTACGCCACCGGCCAGGTGATCGGCGACATCAAGGAGGCGTACTGCAACATCTCGGAGT
CCAAGTGGAACGAGACCCTGCAGCGCGTGTCCAAGAAGCTGAAGGAGTACTTCCCCCACAAGAACATCACCTTCCAGCCGTCGTCCGGCG
GCGACCTCGAGATCACCACGCACTCCTTCAACTGCGGTGGCGAGTTCTTCTACTGCAACACGTCGTCGCTGTTCAACCGCACCTACATGG
CCAACTCCACCGACATGGCCAACTCCACCGAGACCAACTCCACGCGCACCATCACGATCCGCTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAAGAACAACACGGACACGGAGACCTTCAGGCCAGGCGGAGGCAACATGAAGGACAACTGGCGCTCCGAGCTGTACAAGTACA
AGGTGGTGGAGGTGAAGCCCCTGGGCGTGGCACCCACCAACGCCCGCAGGCGCGTCGTGGAGCGCGAGAAGCGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
ACGTGTACTGGAACTCGTCCTGGTCCAACAAGACCTACGGCGACATCTGGGACAACATGACCTGGATGCAGTGGGAGCGCGAGATCTCCA
ACTACACCGAGATCATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA

Fig. 21 cont.
TCATCTTCGCCGTGCTGTCGCTGGTGAACCGCGTGCGCCAGGGCTGATGAGaggacccgaattcggtaaccggatccagatctgctgtgc
ctt
>HV1300687
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCGACGGCCAACGCCACCGCGTCCAACTCCTCCATCATCGAGGGCA
TGAAGAACTGCTCCTTCAACATCACGACGGAGCTGCGCGACAAGCGCGAGAAGAAGAACGCCCTGTTCTACAAGCTGGACATCGTGCAGC
TGGACGGCAACTCCTCGCAGTACAGGCTGATCAACTGCAACACCTCCGTCATCACGCAGGCGTGCCCCAAGGTGCCTTCGACCCCATCC
CCATCCACTACTGCGCCCCCGCCGGCTACGCCATCCTGAAGTGCAACAACAAGACCTTCACCGGCACCGGCCCGTGCAACAACGTGTCCA
CCGTGCAGTGCACGCACGGGATCAAGCCCGTGGTGTCCACGCAGCTGCTCCTGAACGGGTCGCTGGCCGAGGGCGAGATCATCATCCGGT
CCGAGAACATCACGAACAACGCGAAGACCATCATCGTGCACCTGAACGAGTCCGTGAAGATCGAGTGCACCCGCCCGAACAACAAGACGC
GCACCTCCATCCGGATCGGCCCTGGCCAGGCCTTCTACGCCACCGGCCAGGTGATCGGCGACATCCGCGAGGCGTACTGCAACATCAGCG
AGTCCAAGTGGAACGAGACCCTGCAGCGCGTGTCCAAGAAGCTGAAGGAGTACTTCCCCCACAAGAACATCACCTTCCAGCCGTCGTCCG
GCGGCGACCTCGAGATCACCACGCACTCCTTCAACTGCGGTGGCGAGTTCTTCTACTGCAACACGTCGTCGCTGTTCAACCGCACCTACA
TGGCCAACTCCACCGACATGGCCAACTCCACCGAGACCAACTCCACGCGCATCATCACGATCCACTGCCGCATCAAGCAGATCATCAACA
TGTGGCAGGAGGTGGGCCGCGCCATGTACGCACCGCCCATCGCCGGCAACATCACCTGCATCTCCAACATCACCGGCCTCCTGCTGACCC
GCGACGGCGGCAAGAACAACCCGGAGACCTTCAGGCCAGGCGGAGGCAACATGAAGGACAACTGGCGCTCCGAGCTGTACAAGTACAAGG
TGGTGGAGGTGAAGCCCTGGGCGTGGCACCCACCAACGCCCGCAGGCGCGTCGTGGAGCGCGAGAAGCGCGCGTGGGCCTCGGCGCCG
TGTTCCTGGGCTTCCTGGGCGCTGCGGGCTCCACCATGGGTGCCGCGTCCATCACCCTGACCGTGCAGGCCCGCCAGCTGCTCTCCGGCA
TCGTGCAGCAGCAGTCCAACCTCCTGAAGGCCATCGAGGCCCAGCAGCACATGCTGAAGCTGACCGTGTGGGGCATCAAGCAGCTGCAGG
CCAGGGTGCTCGCGCTCGAGCGCTACCTGAAGGACCAGCAGCTGCTCGGCATGTGGGGCTGCTCCGGCAAGCTGATCTGCACCACCAACG
TGTACTGGAACTCGTCCTGGTCCAACAAGACCTACGGCGACATCTGGGACAACATGACCTGGATGCAGTGGGAGCGCGAGATCTCCAACT
ACACCGAGATCATCTACGAGCTCCTCGAGGAGTCCCAGAACCAGCAGGAGAAGAACGAGCAGGATCTGCTCGCGCTGGACCGCTGGAACT
CCCTGTGGAACTGGTTCAACATCACCAACTGGCTGTGGTACATCAAGATCTTCATCATGATCGTGGGCGGCCTGATCGGCCTGCGCATCA
TCTTCGCCGTGCTGTCGCTGGTGAACCGCGTGCGCCAGGGCTGATGAGaggtcccgaattcggtaaccggatccagatctgctgtgccttt
>HV1300688
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCGACGACCAACGCCACCGCGTCCAACTCCTCCATCATCGAGGGCA
TGAAGAACTGCTCCTTCAACATCACGACGGAGCTGCGCGACAAGCGCGAGAAGAAGAACGCCCTGTTCTACAAGCTGGACATCGTGCAGC
TGGACGGCAACTCCTCGCAGTACAGGCTGATCAACTGCAACACCTCCGTCATCACGCAGGCGTGCCCCAAGGTGTCCTTCGACCCCATCC
CCATCCACTACTGCGCCCCCGCCGGCTACGCCATCCTGAAGTGCAACAACAAGACCTTCACCGGCACCGGCCCGTGCAACAACGTGTCCA
CCGTGCAGTGCACGCACGGGATCAAGCCCGTGGTGTCCACGCAGCTGCTCCTGAACGGGTCGCTGGCCGAGGGCGAGATCATCATCCGGT
CCGAGAACATCACGAACAACGCGAAGACCATCATCGTGCACCTGAACGAGTCCGTGAAGATCGAGTGCACCCGCCCGAACAACAAGACGC
GCACCTCCATCCGGATCGGCCCTGGCCAGGCCTTCTACGCCACCGGCCAGGTGATCGGCGACATCCGCGAGGCGTACTGCAACATCAGCG
AGTCCAAGTGGAACGAGACCCTGCAGCGCGTGTCCAAGAAGCTGAAGGAGTACTTCCCCCACAAGAACATCACCTTCCAGCCGTCGTCCG
GCGGCGACCTCGAGATCACCACGCACTCCTTCAACTGCGGTGGCGAGTTCTTCTACTGCAACACGTCGTCGCTGTTCAACCGCACCTACA
TGGCCAACTCCACCGACATGGCCAACTCCACCGAGACCAACTCCACGCGCATCATCACGATCCACTGCCGCATCAAGCAGATCATCAACA
TGTGGCAGGAGGTGGGCCGCGCCATGTACGCACCGCCCATCGCCGGCAACATCACCTGCATCTCCAACATCACCGGCCTCCTGCTGACCC
GCGACGGCGGCAAGAACAACGAGGGACGAGGCAAGAACAACGCGGAGACCTTCAGGCCAGGCGGAGGCAACATGAAGGACAACTGGCGCT
CCGAGCTGTACAAGTACAAGGTGGTGGAGGTGAAGCCCCTGGGCGTGGCACCCACCAACGCCCGCAGGCGCGTCGTGGAGCGCGAGAAGC
GCGCCGTGGGCATGGGCGCCGTGTTCCTGGGCTTCCTGGGCGCTGCGGGCTCCACCATGGGTGCCGCGTCCATCACCCTGACCGTGCAGG
CCCGCCAGCTGCTCTCCGGCATCGTGCAGCAGCAGTCCAACCTCCTGAAGGCCATCGAGGCCCAGCAGCACATGCTGAAGCTGACCGTGT
GGGGCATCAAGCAGCTGCAGGCCAGGGTGCTCGCGCTCGAGCGCTACCTGAAGGACCAGCAGCTGCTCGGCATGTGGGGCTGCTCCGGCA
AGCTGATCTGCACCACCAACGTGTACTGGAACTCGTCCTGGTCCAACAAGACCTACGGCGACATCTGGGACAACATGACCTGGATGCAGT
GGGAGCGCGAGATCTCCAACTACACCGAGATCATCTACGAGCTCCTCGAGGAGTCCCAGAACCAGCAGGAGAAGAACGAGCAGGATCTGC
TCGCGCTGGACCGCTGGAACTCCCTGTGGAACTGGTTCAACATCACCAACTGGCTGTGGTACATCAAGATCTTCATCATGATCGTGGGCG
GCCTGATCGGCCTGCGCATCATCTTCGCCGTGCTGTCGCTGGTGAACCGCGTGCGCCAGGGCTGATGAGggtcctgaattcggtaaccgg
atccagatctgctgtgcctt
>HV1300689
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG

Fig. 21 cont.

```
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCGACGACGAACGCCACCGCGTCCAACTCGTCCATCATCGAGGAGA
TGAAGAACTGCTCCTTCAACATCACGACGGAGCTGCGCGACAAGCGCGAGAAGAAGAACGCCCTGTTCTACAAGCTGGACATCGTGCAGC
TGGACGGCAACTCCTCGCAGTACAGGCTGATCAACTGCAACACCTCCGTCATCACGCAGGCGTGCCCCAAGGTGTCCTTCGACCCCATCC
CCATCCACTACTGCGCCCCCGCCGGCTACGCCATCCTGAAGTGCAACAACAAGACCTTCACCGGCACCGGCCCGTGCAACAACGTGTCCA
CCGTGCAGTGCACGCACGGGATCAAGCCCGTGGTGTCCACGCAGCTGCTCCTGAACGGGTCGCTGGCCGAGGGCGAGATCATCATCCGGT
CCGAGAACATCACGAACACGGCGAAGACCATCATCGTGCACCTGAACGAGTCCGTGAAGATCGAGTGCACCCGCCCGAACAACAAGACGC
GCACCTCCATCCGGATCGGCCCTGGCCAGGCCTTCTACGCCACCGGCCAGGTGATCGGCGACATCCGCGAGGCGTACTGCAACATCTCGG
AGTCCAAGTGGAACGAGACCCTGCAGCGCGTGTCCAAGAAGCTGAAGGAGTACTTCCCCCACAAGAACATCACCTTCCAGCCGTCGTCCG
GCGGCGACCTCGAGATCACCACGCACTCCTTCAACTGCGGTGGCGAGTTCTTCTACTGCAACACGTCGTCGCTGTTCAACCGCACCTACA
TGGCCAACTCCACCGACATGGCCAACTCCACCGAGACCAACTCCACGCGCACCATCACGATCCGGTGCCGCATCAAGCAGATCATCAACA
TGTGGCAGGAGGTGGGCCGCGCCATGTACGCACCGCCCATCGCCGGCAACATCACCTGCATCTCCAACATCACCGGCCTCCTGCTGACCC
GCGACGGCGGCGAGAACAACACGGAGACCTTCAGGCCAGGCGGAGGCAACATGAAGGACAACTGGCGCTCCAGCTGTACAAGTACAAGG
TGGTGGAGGTGAAGCCCCTGGGCGTGGCACCCACCAACGCCCGCAGGCGCGTCGTGGAGCGCGAGAAGCGCGCCGTGGGCATGGGCGCCG
TGTTCCTGGGCTTCCTGGGCGCTGCGGGCTCCACCATGGGTGCCGCGTCCATCACCCTGACCGTGCAGGCCCGCCAGCTGCTCTCCGGCA
TCGTGCAGCAGCAGTCCAACCTCCTGAAGGCCATCGAGGCCCAGCAGCACATGCTGAAGCTGACCGTGTGGGGCATCAAGCAGCTGCAGG
CCAGGGTGCTCGCGCTCGAGCGCTACCTGAAGGACCAGCAGCTGCTCGGCATGTGGGGCTGCTCCGGCAAGCTGATCTGCACCACCAACG
TGTACTGGAACTCGTCCTGGTCCAACAAGACCTACGGCGACATCTGGGACAACATGACCTGGATGCAGTGGGAGCGCGAGATCTCCAACT
ACACCGAGATCATCTACGAGCTCCTCGAGGAGTCCCAGAACCAGCAGGAGAAGAACGAGCAGGATCTGCTCGCGCTGGACCGCTGGAACT
CCCCTGTGGAACTGGTTCAACATCACCAACTGGCTGTGGTACATCAAGATCTTCATCATGATCGTGGGCGGCCTGATCGGCCTGCGCATCA
TCTTCGCCGTGCTGTCGCTGGTGAACCGCGTGCGCCAGGGCTGATGAGggtcccgaattcggttaccggatccagatctgctgtgccttt
>HV1300690
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCGACGGCCTCCAACGCCACCGCGTCCAACTCCTCCATCATCGAGG
GCATGAAGAACTGCTCCTTCAACATCACGACGGAGCTGCGCGACAAGCGCGAGAAGAAGAACGCCCTGTTCTACAAGCTGGACATCGTGC
AGCTGGACGGCAACTCCTCGCAGTACAGGCTGATCAACTGCAACACCTCCGTCATCACGCAGGCGTGCCCCAAGGTGTCCTTCGACCCCA
TCCCCATCCACTACTGCGCCCCCGCCGGCTACGCCATCCTGAAGTGCAACAACAAGACCTTCACCGGCACCGGCCCGTGCAACAACGTGT
CCACCGTGCAGTGCACGCACGGGATCAAGCCCGTGGTGTCCACGCAGCTGCTCCTGAACGGGTCGCTGGCCGAGGGCGAGATCATCATCC
GGTCCGAGAACATCACGAACAACGGGAAGACCATCATCGTGCACCTGAACGAGTCCGTGAAGATCGAGTGCACCCGCCCGAGCAACAAGA
CGCGCACCTCCATCCGGATCGGCCCTGGCCAGGCCTTCTACGCCACCGGCCAGGTGATCGGCGACATCCGCGAGGCGCACTGCAACATCT
CGGAGTCCAAGTGGAACGAGACCCTGCAGCGCGTGTCCAAGAAGCTGAAGGAGTACTTCCCCCACAAGAACATCACCTTCCAGCCGTCGT
CCGGCGGCGACCTCGAGATCACCACGCACTCCTTCAACTGCGGTGGCGAGTTCTTCTACTGCAACACGTCGTCGCTGTTCAACCGCACCT
ACATGGCCAACTCCACCGACATGGCCAACTCCACCGAGACCAACTCCACGCGCACCATCACGCTCCACTGCCGCATCAAGCAGATCATCA
ACATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAAGAACAACACCGACACGGAGACCTTCAGGCCAGGCGGAGGCAACATGAAGGACAACTGGCGCTCCGAGCTGTACA
AGTACAAGGTGGTGGAGGTGAAGCCCCTGGGCGTGGCACCCACCAACGCCCGCAGGCGCGTCGTGGAGCGCGAGAAGCGCGCCGTGGGCA
TGGGCGCCGTGTTCCTGGGCTTCCTGGGCGCTGCGGGCTCCACCATGGGTGCCGCGTCCATCACCCTGACCGTGCAGGCCCGCCAGCTGC
TCTCCGGCATCGTGCAGCAGCAGTCCAACCTCCTGAAGGCCATCGAGGCCCAGCAGCACATGCTGAAGCTGACCGTGTGGGGCATCAAGC
AGCTGCAGGCCAGGGTGCTCGCGCTCGAGCGCTACCTGAAGGACCAGCAGCTGCTCGGCATGTGGGGCTGCTCCGGCAAGCTGATCTGCA
CCACCAACGTGTACTGGAACTCGTCCTGGTCCAACAAGACCTACGGCGACATCTGGGACAACATGACCTGGATGCAGTGGGAGCGCGAGA
TCTCCAACTACACCGAGATCATCTACGAGCTCCTCGAGGAGTCCCAGAACCAGCAGGAGAAGAACGAGCAGGATCTGCTCGCGCTGGACC
GCTGGAACTCCCCTGTGGAACTGGTTCAACATCACCAACTGGCTGTGGTACATCAAGATCTTCATCATGATCGTGGGCGGCCTGATCGGCC
TGCGCATCATCTTCGCCGTGCTGTCGCTGGTGAACCGCGTGCGCCAGGGCTGATGAGaggacccgaattcggttaccggatccagatctg
ctgtgccttt
>HV1300691
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCGACGACCAACGCCACCGCGTCCAACTCCTCCATCATCGAGGGCA
TGAAGAACTGCTCCTTCAACATCACGACGGAGCTGCGCGACAAGCGCGAGAAGAAGAACGCCCTGTTCTACAAGCTGGACATCGTGCAGC
TGGACGGCAACTCCTCGCAGTACAGGCTGATCAACTGCAACACCTCCGTCATCACGCAGGCGTGCCCCAAGGTGTCCTTCGACCCCATCC
CCATCCACTACTGCGCCCCCGCCGGCTACGCCATCCTGAAGTGCAACAACAAGACCTTCACCGGCACCGGCCCGTGCAACAACGTGTCCA
CCGTGCAGTGCACGCACGGGATCAAGCCCGTGGTGTCCACGCAGCTGCTCCTGAACGGGTCGCTGGCCGAGGGCGAGATCATCATCCGGT
```

Fig. 21 cont.
```
CCGAGAACATCACGAACAACGCGAAGACCATCATCGTGCACCTGAACGAGTCCGTGAAGATCGAGTGCACCCGCCCGAACAACAAGACGC
GCACCTCCATCCGGATCGGCCCTGGCCAGGCCTTCTACGCCACCGGCCAGGTGATCGGCGACATCCGCGAGGCGCACTGCAACATCAGCG
AGTCCAAGTGGAACGAGACCCTGCAGCGCGTGTCCAAGAAGCTGAAGGAGTACTTCCCCCACAAGAACATCACCTTCCAGCCGTCGTCCG
GCGGCGACCTCGAGATCACCACGCACTCCTTCAACTGCGGTGGCGAGTTCTTCTACTGCAACACGTCGTCGCTGTTCAACCGCACCTACA
TGGCCAACTCCACCGACATGGCCAACTCCACCGAGACCAACTCCACGCGCACCATCACGATCCGCTGCCGCATCAAGCAGATCATCAACA
TGTGGCAGGAGGTGGGCCGCGCCATGTACGCACCGCCCATCGCCGGCAACATCACCTGCATCTCCAACATCACCGGCCTCCTGCTGACCC
GCGACGGCGGCAAGAACAACACCGACACGGAGACCTTCAGGCCAGGCGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTCGTGGAGCGCGAGAAGCGCGCCGTGGGCATGG
GCGCCGTGTTCCTGGGCTTCCTGGGCGCTGCGGGCTCCACCATGGGTGCCGCGTCCATCACCCTGACCGTGCAGGCCCGCCAGCTGCTCT
CCGGCATCGTGCAGCAGCAGTCCAACCTCCTGAAGGCCATCGAGGCCCAGCAGCACATGCTGAAGCTGACCGTGTGGGGCATCAAGCAGC
TGCAGGCCAGGGTGCTCGCGCTCGAGCGCTACCTGAAGGACCAGCAGCTGCTCGGCATGTGGGGCTGCTCCGGCAAGCTGATCTGCACCA
CCAACGTGTACTGGAACTCGTCCTGGTCCAACAAGACCTACGGCGACATCTGGGACAACATGACCTGGATGCAGTGGGAGCGCGAGATCT
CCAACTACACCGAGATCATCTACAGCTCCTCGAGGAGTCCCAGAACCAGCAGGAGAAGAACGAGCAGGATCTGCTCGCGCTGGACCGCT
GGAACAACCTGTGGAACTGGTTCAACATCACCAACTGGCTGTGGTACATCAAGATCTTCATCATGATCGTGGGCGGCCTGATCGGCCTGC
GCATCATCTTCGCCGTGCTGTCGCTGGTGAACCGCGTGCGCCAGGGCTGATGAGaggtcccgaattcggttaccggatccagatctgctg
tgcctt
>HV1300692
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCGACGGCCAGCAACGCCACCGCGTCCAACTCCTCCATCATCGAGG
GCATGAAGAACTGCTCCTTCAACATCACGACGGAGCTGCGCGACAAGCGCGAGAAGAAGAACGCCCTGTTCTACAAGCTGGACATCGTGC
AGCTGGACGGCAACTCCTCGCAGTACAGGCTGATCAACTGCAACACCTCCGTCATCACGCAGGCGTGCCCCAAGGTGTCCTTCGACCCCA
TCCCCATCCACTACTGCGCCCCCGCCGGCTACGCCATCCTGAAGTGCAACAACAAGACCTTCACCGGCACCGGCCCGTGCAACAACGTGT
CCACCGTGCAGTGCACGCACGGGATCAAGCCCGTGGTGTCCACGCAGCTGCTCCTGAACGGGTCGCTGGCCGAGGGCGAGATCATCATCC
GGTCCGAGAACATCACGAACAACGTGAAGACCATCATCGTGCACCTGAACGAGTCCGTGAAGATCGAGTGCACCCGCCCGAACAACAAGA
CGCGCACCTCCATCCGGATCGGCCCTGGCCAGGCCTTCTACGCCACCGGCCAGGTGATCGGCAACATCCGCGAGGCGTACTGCAACATCT
CGGAGTCCAAGTGGAACGAGACCCTGCAGCGCGTGTCCAAGAAGCTGAAGGAGTACTTCCCCCACAAGAACATCACCTTCCAGCCGTCGT
CCGGCGGCGACCTCGAGATCACCACGCACTCCTTCAACTGCGGTGGCGAGTTCTTCTACTGCAACACGTCGTCGCTGTTCAACCGCACCT
ACATGGCCAACTCCACCGACATGGCCAACTCCACCGAGACCAACTCCACGCGCATCATCACGATCCACTGCCGCATCAAGCAGATCATCA
ACATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAAGAACAACACCGACACGGAGACCTTCAGGCCAGGCGGAGGCAACATGAAGGACAACTGGCGCTCCGAGCTGTACA
AGTACAAGGTGGTGGAGGTGAAGCCCCTGGGCGTGGCACCCACCAACGCCCGCAGGCGCGTCGTGGAGCGCGAGAAGCGCGCCGTGGGCA
TGGGCGCCGTGTTCCTGGGCTTCCTGGGCGCTGCGGGCTCCACCATGGGTGCCGCGTCCATCACCCTGACCGTGCAGGCCCGCCAGCTGC
TCTCCGGCATCGTGCAGCAGCAGTCCAACCTCCTGAAGGCCATCGAGGCCCAGCAGCACATGCTGAAGCTGACCGTGTGGGGCATCAAGC
AGCTGCAGGCCAGGGTGCTCGCGCTCGAGCGCTACCTGAAGGACCAGCAGCTGCTCGGCATGTGGGGCTGCTCCGGCAAGCTGATCTGCA
CCACCAACGTGTACTGGAACTCGTCCTGGTCCAACAAGACCTACGGCGACATCTGGGACAACATGACCTGGATGCAGTGGGAGCGCGAGA
TCTCCAACTACACCGAGATCATCTACAGCTCCTCGAGGAGTCCCAGAACCAGCAGGAGAAGAACGAGCAGGATCTGCTCGCGCTGGACC
GCTGGAACTCCCTGTGGAACTGGTTCAACATCACCAACTGGCTGTGGTACATCAAGATCTTCATCATGATCGTGGGCGGCCTGATCGGCC
TGCGCATCATCTTCGCCGTGCTGTCGCTGGTGAACCGCGTGCGCCAGGGCTGATGAGggacctgaattcggttaccggatccagatctgc
tgtgccctt
>HV1300693
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCgTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCGACGGCCAACGCCACCGCGTCCAACTCCTCCATCATCGAGGGCA
TGAAGAACTGCTCCTTCAACATCACGACGGAGCTGCGCGACAAGCGCGAGAAGAAGAACGCCCTGTTCTACAAGCTGGACATCGTGCAGC
TGGACGGCAACTCCTCGCAGTACAGGCTGATCAACTGCAACACCTCCGTCATCACGCAGGCGTGCCCCAAGGTGTCCTTCGACCCCATCC
CCATCCACTACTGCGCCCCCGCCGGCTACGCCATCCTGAAGTGCAACAACAAGACCTTCAACGGCACCGGCCCGTGCAACAACGTGTCCA
CCGTGCAGTGCACGCACGGGATCAAGCCCGTGGTGTCCACGCAGCTGCTCCTGAACGGGTCGCTGGCCGAGGGCGAGATCATCATCCGGT
CCGAGAACATCACGAACAACGTGAAGACCATCATCGTGCACCTGAACGAGTCCGTGAAGATCGAGTGCACCCGCCCGAACAACAAGACGC
GCACCTCCATCCGGATCGGCCCTGGCCAGGCCTTCTACGCCACCGGCCAGGTGATCGGCGACATCCGCGAGGCGTACTGCAACATCTCGG
AGTCCAAGTGGAACGAGACCCTGCAGCGCGTGTCCAAGAAGCTGAAGGAGTACTTCCCCCACAAGAACATCACCTTCCAGCCGTCGTCCG
GCGGCGACCTCGAGATCACCACGCACTCCTTCAACTGCGGTGGCGAGTTCTTCTACTGCAACACGTCGTCGCTGTTCAACCGCACCTACA
TGGCCAACTCCACCGACATGGCCAACTCCACCGAGACCAACTCCACGCGCACCATCAAGATCCACTGCCGCATCAAGCAGATCATCAACA
```

Fig. 21 cont.
TGTGGCAGGAGGTGGGCCGCGCCATGTACGCACCGCCCATCGCCGGCAACATCACCTGCATCTCCAACATCACCGGCCTCCTGCTGACCC
GCGACGGCGGCAAGAACAACACCGACACGGAGACCTTCAGGCCAGGCGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTCGTGGAGCGCGAGAAGCGCGCCGTGGGCATGG
GCGCCGTGTTCCTGGGCTTCCTGGGCGCTGCGGGCTCCACCATGGGTGCCGCGTCCATCACCCTGACCGTGCAGGCCCGCCAGCTGCTCT
CCGGCATCGTGCAGCAGCAGTCCAACCTCCTGAAGGCCATCGAGGCCCAGCAGCACATGCTGAAGCTGACCGTGTGGGGCATCAAGCAGC
TGCAGGCCAGGGTGCTCGCGCTCGAGCGCTACCTGAAGGACCAGCAGCTGCTCGGCATGTGGGGCTGCTCCGGCAAGCTGATCTGCACCA
CCAACGTGTACTGGAACTCGTCCTGGTCCAACAAGACCTACGGCGACATCTGGGACAACATGACCTGGATGCAGTGGGAGCGCGAGATCT
CCAACTACACCGAGATCATCTACGAGCTCCTCGAGGAGTCCCAGAACCAGCAGGAGAAGAACGAGCAGGATCTGCTCGCGCTGGACCGCT
GGAACTCCCTGTGGAACTGGCTCAACATCACCAACTGGCTGTGGTACATCAAGATCTTCATCATGATCGTGGGCGGCCTGATCGGCCTGC
GCATCATCTTCGCCGTGCTGTCGCTGGTGAACCGCGTGCGCCAGGGCTGATGAGaattcggtgaccgggacccggatccagatctgctgt
gcctt
>HV1300694
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCGACGAACGCCACCGCGTCCAACTCCTCCATCCTCGAGGGCATGA
AGAACTGCTCCTTCAACATCACGACGGAGCTGCGCGACAAGCGCGAGAAGAAGAACGCCCTGTTCTACAAGCTGGACATCGTGCAGCTGG
ACGGCAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCCG
AGAACATCACGGACAACGGGAAGACCATCATCGTCGACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCGACATCCGCGAGGCGCACTGCAACATCTCGGAGT
CCAAGTGGAACGAGACCCTGCAGCGCGTGTCCAAGAAGCTGAAGGAGTACTTCCCCCACAAGAACATCACCTTCCAGCCGTCGTCGGCG
GCGACCTCGAGATCACCACGCACTCCTTCAACTGCGGTGGCGAGTTCTTCTACTGCAACACGTCGTCGCTGTTCAACCGCACCTACATGG
CCAACTCCACCGAGACCAACTCCACGCGCACCATCACGCTCCACTGCCGCATCAAGCAGATCATCAACATGTGGCAGGAGGTGGGCCGCG
CCATGTACGCACCGCCCATCGCCGGCAACATCACCTGCATCTCCAACATCACCGGCCTCCTGCTGACCCGCGACGGCGGCAAGAACAACA
CGGAGACCTTCGAGACGTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGTCGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGaattcggtcaccgggacccggatccagatctgctgtgcctt
>HV1300695
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCGACGAACGCCACCGCGTCCAACTCCTCCATCCTCGAGGGCATGA
AGAACTGCTCCTTCAACATCACGACGGAGCTGCGCGACAAGCGCGAGAAGAAGAACGCCCTGTTCTACAAGCTGGACATCGTGCAGCTGG
ACGGCAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCCG
AGAACATCACGGACAACGGGAAGACCATCATCGTCGACCTGAACGAGTCCGTGAAGATCGAGTGCACCCGCCCGTCGAACAACACGCGCA
CCTCCATCCGGATCGGCCCTGGCCAGGCCTTCTACGCCACCGGCCAGGTGATCGGCGACATCCGCGAGGCGCACTGCAACATCTCGGAGT
CCAAGTGGAACGAGACCCTGCAGCGCGTGTCCAAGAAGCTGAAGGAGTACTTCCCCCACAAGAACATCACCTTCCAGCCGTCGTCCGGCG
GCGACCTCGAGATCACCACGCACTCCTTCAACTGCGGTGGCGAGTTCTTCTACTGCAACACGTCGTCGCTGTTCAACCGCACCTACATGG
CCAACTCCACCGAGACCAACTCCACGCGCACCATCACGATCCGCTGCCGCATCAAGCAGATCATCAACATGTGGCAGGAGGTGGGCCGCG
CCATGTACGCACCGCCCATCGCCGGCAACATCACCTGCATCTCCAACATCACCGGCCTCCTGCTGACCCGCGACGGCGGCGAGAACAACA
CGGAGACCTTCGAGACGTTCAGGCCAGGCGGAGGCAACATGAAGGACAACTGGCGCTCCGAGCTGTACAAGTACAAGGTGGTGGAGGTGA
AGCCCCTGGGCGTGGCACCCACCAACGCCCGCAGGCGCGCGGTGGAGCGCGAGAAGCGCGCCGTGGGCATGGGCGCCGTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGTGTACTGGAACT

Fig. 21 cont.
```
CGTCCTGGTCCAACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCATCTTCGCCGTGC
TGTCGCTGGTGAACCGCGTGCGCCAGGGCTGATGAGaattcggtaaccgggacccggatccagatctgctgtgccttt
>HV1300696
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCGAACGCCACCGCGTCCAACTCCTCTATCATCGAGGGGATGAACT
CCTCCATCATCGAGGGCATGAAGAACTGCTCCTTCAACATCACGACGGAGCTGCGCGACAAGCGCGAGAAGAAGAACGCCCTGTTCTACA
AGCTGGACATCGTGCAGCTGGACGGCAACTCCTCGCAGTACAGGCTGATCAACTGCAACACCTCCGTCATCACGCAGGCGTGCCCCAAGG
TGTCCTTCGACCCCATCCCCATCCACTACTGCGCCCCCGCCGGCTACGCCATCCTGAAGTGCAACAACAAGACCTTCAACGGCACCGGCC
CGTGCAACAACGTGTCCACCGTGCAGTGCACGCACGGGATCAAGCCCGTGGTGTCCACGCAGCTGCTCCTGAACGGGTCGCTGGCCGAGG
GCGAGATCATCATCCGGTCCGAGAACATCACGGACAACGGGAAGACCATCATCGTGCACCTGAACGAGTCCGTGAAGATCGAGTGCACCC
GCCCGAGCAACAACACGCGCACCTCCATCCGGATCGGCCCTGGCCAGGCCTTCTACGCCACCGGCCAGGTGATCGGCGACATCCGCGAGG
CGCACTGCAACATCTCGGAGTCCAAGTGGAACGAGACCCTGCAGCGCGTGTCCGAGAAGCTGAAGGAGTACTTCCCCCACAAGAACATCA
CCTTCCAGCCGTCGTCCGGCGGCGACCTCGAGATCACCACGCACTCCTTCAACTGCGGTGGCGAGTTCTTCTACTGCAACACGTCGTCGC
TGTTCAACCGCACCTACATGGCCACGTCCACCGACATGGCCAACTCCACCGAGACCAACTCCACGCGCATCATCACGATCCGGTGCCGCA
TCAAGCAGATCATCAACATGTGGCAGGAGGTGGGCCGCGCCATGTACGCACCGCCCATCGCCGGCAACATCACCTGCATCTCCAACATCA
CCGGCCTCCTGCTGACCCGCGACGGCGGCAAGAACAACACGGAGACCTTCGAGACGTTCAGGCCAGGCGGAGGCAACATGAAGGACAACT
GGCGCTCCGAGCTGTACAAGTACAAGGTGGTGGAGGTGAAGCCCCTGGGCGTGGCACCCACCAACGCCCGCAGGCGCGTCGTGGAGCGCG
AGAAGCGCGCCGTGGGCATGGGCGCCGTGTTCCTGGGCTTCCTGGGCGCTGCGGGCTCCACCATGGGTGCCGCGTCCATCACCCTGACCG
TGCAGGCCCGCCAGCTGCTCTCCGGCATCGTGCAGCAGCAGTCCAACCTCCTGAAGGCCATCGAGGCCCAGCAGCACATGCTGAAGCTGA
CCGTGTGGGGCATCAAGCAGCTGCAGGCCAGGGTGCTCGCGCTCGAGCGCTACCTGAAGGACCAGCAGCTGCTCGGCATGTGGGGCTGCT
CCGGCAAGCTGATCTGCACCACCAACGTGTACTGGAACTCGTCCTGGTCCAACAAGACCTACGGCGACATCTGGGACAACATGACCTGGA
TGCAGTGGGAGCGCGAGATCTCCAACTACACCGAGATCATCTACGAGCTCCTCGAGGAGTCCCAGAACCAGCAGGAGAAGAACGAGCAGG
ATCTGCTCGCGCTGGACCGCTGGAACTCCCTGTGGAACTGGTTCAACATCACCAACTGGCTGTGGTACATCAAGATCTTCATCATGATCG
TGGGCGGCCTGATCGGCCTGCGCATCATCTTCGCCGTGCTGTCGCTGGTGAACCGCGTGCGCCAGGGCTGATGAGaattcggtgaccggg
tcccggatccagatctgctgtgccttt
>HV1300697
gtcgacaagaagccaccATGCGCGTGATGGGCATCCAGCGCAACTACCCGCAGTGGTGGATCTGGTCGATGCTGGGCCTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGGAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCGACGCCACCGCGTCCAACGCAACCGCGAGCAACGCCACGGCGTCGAACT
CCTCCATCATCGAGGGCATGAAGAACTGCTCCTTCAACATCACGACGGAGCTGCGCGACAAGCGCGAGAAGAAGAACGCCCTGTTCTACA
AGCTGGACATCGTGCAGCTGGACGGCAACTCCTCGCAGTACAGGCTGATCAACTGCAACACCTCCGTCATCACGCAGGCGTGCCCCAAGG
TGTCCTTCGACCCCATCCCCATCCACTACTGCGCCCCCGCCGGCTACGCCATCCTGAAGTGCAACAACAAGACCTTCAACGGCACCGGCC
CGTGCAACAACGTGTCCACCGTGCAGTGCACGCACGGGATCAAGCCCGTGGTGTCCACGCAGCTGCTCCTGAACGGGTCGCTGGCCGAGG
GCGAGATCATCATCCGGTCCGAGAACATCACGGACAACGGGAAGACCATCATCGTGCACCTGAACGAGTCCGTGAAGATCGAGTGCACCC
GCCCGAGCAACAACACGCGCACCTCCATCCGGATCGGCCCTGGCCAGGCCTTCTACGCCACCGGCCAGGTGATCGGCGACATCCGCGAGG
CGCACTGCAACATCTCGGAGAACAAGTGGAACGAGACCCTGCAGCGCGTGTCCAAGAAGCTGAAGGAGTACTTCCCCCACAAGAACATCA
CCTTCCAGCCGTCGTCCGGCGGCGACCTCGAGATCACCACGCACTCCTTCAACTGCGGTGGCGAGTTCTTCTACTGCAACACGTCGTCGC
TGTTCAACCGCACCTACATGGCCACGTCCACCGACATGGCCAACTCCACCGAGACCAACTCCACGCGCATCATCACGATCCGCTGCCGCA
TCAAGCAGATCATCAACATGTGGCAGGAGGTGGGCCGCGCCATGTACGCACCGCCCATCGCCGGCAACATCACCTGCATCTCCAACATCA
CCGGCCTCCTGCTGACCCGCGACGGCGGCAAGAACAACACGGAGACCTTCGAGACGTTCAGGCCAGGCGGAGGCAACATGAAGGACAACT
GGCGCTCCGAGCTGTACAAGTACAAGGTGGTGGAGGTGAAGCCCCTGGGCGTGGCACCCACCAACGCCCGCAGGCGCGTCGTGGAGCGCG
AGAAGCGCGCCGTGGGCATGGGCGCCGTGTTCCTGGGCTTCCTGGGCGCTGCGGGCTCCACCATGGGTGCCGCGTCCATCACCCTGACCG
TGCAGGCCCGCCAGCTGCTCTCCGGCATCGTGCAGCAGCAGTCCAACCTCCTGAAGGCCATCGAGGCCCAGCAGCACATGCTGAAGCTGA
CCGTGTGGGGCATCAAGCAGCTGCAGGCCAGGGTGCTCGCGCTCGAGCGCTACCTGAAGGACCAGCAGCTGCTCGGCATGTGGGGCTGCT
CCGGCAAGCTGATCTGCACCACCAACGTGTACTGGAACTCGTCCTGGTCCAACAAGACCTACGGCGACATCTGGGACAACATGACCTGGA
TGCAGTGGGAGCGCGAGATCTCCAACTACACCGAGATCATCTACGAGCTCCTCGAGGAGTCCCAGAACCAGCAGGAGAAGAACGAGCAGG
ATCTGCTCGCGCTGGACCGCTGGAACTCCCTGTGGAACTGGTTCAACATCACCAACTGGCTGTGGTACATCAAGATCTTCATCATGATCG
TGGGCGGCCTGATCGGCCTGCGCATCATCTTCGCCGTGCTGTCGCTGGTGAACCGCGTGCGCCAGGGCTGATGAGaattcggtgaccagg
acccggatccagatctgctgtgccttt
>HV1300698
```

Fig. 21 cont.
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCGACGCCACCGCGTCCAACGCAACCGCGATCAACTCCTCCATCATCGAGG
GCATGAAGAACTGCTCCTTCAACATCACGACGGAGCTGCGCGACAAGCGCGAGAAGAAGAACGCCCTGTTCTACAAGCTGGACATCGTGC
AGCTGGACGGCAACTCCTCGCAGTACAGGCTGATCAACTGCAACACCTCCGTCATCACGCAGGCGTGCCCCAAGGTGTCCTTCGACCCCA
TCCCCATCCACTACTGCGCCCCCGCCGGCTACGCCATCCTGAAGTGCAACAACAAGACCTTCAACGGCACCGGCCGTGCAACAACGTGT
CCACCGTGCAGTGCACGCACGGGATCAAGCCCGTGGTGTCCACGCAGCTGCTCCTGAACGGGTCGCTGGCCGAGGGCGAGATCATCATCC
GGTCCGAGAACATCACGAACAACGCGAAGACCATCATCGTGCACCTGAACGAGTCCGTGAAGATCGAGTGCACCCGCCCGTCGAACAACA
CGCGCACCTCCATCCGGATCGGCCCTGGCCAGGCCTTCTACGCCACCGGCCAGGTGATCGGCGACATCCGCGAGGCGCACTGCAACATCT
CGGAGTCCAAGTGGAACGAGACCCTGCAGCGCGTGTCCAAGAAGCTGAAGGAGTACTTCCCCCACAAGAACATCACCTTCCAGCCGTCGT
CCGGCGGCGACCTCGAGATCACCACGCACTCCTTCAACTGCGGTGGCGAGTTCTTCTACTGCAACACGTCGTCGCTGTTCAACCGCACCT
ACATGGCCAACTCCACCGAGACCAACTCCACGCGCATCATCACGATCCGCTGCCGCATCAAGCAGATCATCAACATGTGGCAGGAGGTGG
GCCGCGCCATGTACGCACCGCCCATCGCCGGCAACATCACCTGCATCTCCAACATCACCGGCCTCCTGCTGACCCGCGACGGCGGCAAGA
ACAACACGGAGACCTTCGAGACGTTCAGGCCAGAGGGAGGCAACATGAAGGACAACTGGCGCTCCGAGCTGTACAAGTACAAGGTGGTGG
AGGTGAAGCCCCTGGGCGTGGCACCCACCAACGCCCGCAGGCGCGTCGTGGAGCGCGAGAAGCGCGCCGTGGGCATGGGCGCCGTGTTCC
TGGGCTTCCTGGGCGCTGCGGGCTCCACCATGGGTGCCGCGTCCATCACCCTGACCGTGCAGGCCCGCCAGCTGCTCTCCGGCATCGTGC
AGCAGCAGTCCAACCTCCTGAAGGCCATCGAGGCCCAGCAGCACATGCTGAAGCTGACCGTGTGGGGCATCAAGCAGCTGCAGGCCAGGG
TGCTCGCGCTCGAGCGCTACCTGAAGGACCAGCAGCTGCTGGGCATCTGGGGCTGCTCCGGCAAGCTGATCTGCACCACCAACGTGTACT
GGAACTCGTCCTGGTCCAACAAGACCTACGGCGACATCTGGGACAACATGACCTGGATGCAGTGGGAGCGCGAGATCTCCAACTACACCG
AGATCATCTACGAGCTCCTCGAGGAGTCCCAGAACCAGCAGGAGAAGAACGAGCAGGATCTGCTCGCGCTGGACCGCTGGAACTCCCTGT
GGAACTGGTTCAACATCACCAACTGGCTGTGGTACATCAAGATCTTCATCATGATCGTGGGCGGCCTGATCGGCCTGCGCATCATCTTCG
CCGTGCTGTCGCTGGTGAACCGCGTGCGCCAGGGCTGATGAGaattcggtgaccaggtcccggatccagatctgctgtgccttt
>HV1300699
gtcgacaagaagccaccATGCGCGTGATGGGCATCCAGCGCAACTACCCGCAGTGGTGGATCTGGTCGATGCTGGGCCTGTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGCGGACCAGATGCACGAGGACGTGATCTCCCTGTGGGACCAGTCCCTGAAGCCCT
GCGTGAAGCTGACCCCGCTGTGCGTGACCCTGAACTGCACCGACGCCACCGCGTCCAACGCAACCGCGAGCAACGCCACGGCGTCGAACT
CGTCCATCAACAGCTCCATCATCGAGGAGATGAAGAACTGCTCCTTCAACATCACGACGGAGCTGCGCGACAAGCGCGAGAAGAAGAACG
CCCTGTTCTACAAGCTGGACATCGTGCAGCTGGACGGCAACTCCTCGCAGTACAGGCTGATCAACTGCAACACCTCCGCGATCACGCAGG
CGTGCCCCAAGGTGTCCTTCGACCCCATCCCCATCCACTACTGCGCCCCCGCCGGCTACGCCATCCTGAAGTGCAACAACAAGACCTTCA
ACGGCACCGGCCCGTGCAACAACGTGTCCACCGTGCAGTGCACGCACGGGATCAAGCCCGTGGTGTCCACGCAGCTGCTCCTGAACGGGT
CGCTGGCCGAGGGCGAGATCATCATCCGGTCCGAGAACATCACGGACAACGGGAAGACCATCATCGTGCACCTGAACGAGTCCGTGAAGA
TCGAGTGCACCCGCCCGAGCAACAACACGCGCACCTCCATCCGGATCGGCCCTGGCCAGGCCTTCTACGCCACCGGCCAGGTGATCGGCG
ACATCCGCGAGGCGCACTGCAACATCTCGGAGTCCAAGTGGAACGAGACCCTGCAGCGCGTGTCCAAGAAGCTGAAGGAGTACTTCCCCC
ACAAGAACATCACCTTCCAGCCGTCGTCCGGCGGCGACCTCGAGGTCACGACGCACTCCTTCAACTGCGGTGGCGAGTTCTTCTACTGCA
ACACGTCGTCGCTGTTCAACCGCACCGACATGGCCAACTCCACCGAGACCAACTCCACGCGCATCATCACCATCCGCTGCCGCATCAAGC
AGATCGTCAACATGTGGCAGGAGGTGGGCCGCGCCATGTACGCACCGCCCATCGCCGGCAACATCACCTGCATCTCCAACATCACCGGCC
TCCTGCTGACCCGCGACGGCGGCGAGAACAACGGCGGGAAGAACAACACGGAGACCTTCAGGCCAGGCGGAGGCAACATGAAGGACAACT
GGCGCTCCGAGCTGTACAAGTACAAGGTGGTGGAGGTGAAGCCCCTGGGCGTGGCACCCACCAACGCCCGCAGGCGCGTCGTGGAGCGCG
AGAAGCGCGCCGTGGGCATGGGCGCCGTGTTCCTGGGCTTCCTGGGCGCTGCGGGCTCCACCATGGGTGCCGCGTCCATCACCCTGACCG
TGCAGGCCCGCCAGCTGCTCTCCGGCATCGTGCAGCAGCAGTCCAACCTCCTGAAGGCCATCGAGGCCCAGCAGCACATGCTGAAGCTGA
CCGTGTGGGGCATCAAGCAGCTGCAGGCCAGGGTGCTCGCGCTCGAGCGCTACCTGAAGGACCAGCAGCTGCTCGGCATGTGGGGCTGCT
CCGGCAAGCTGATCTGCACCACCAACGTGTACTGGAACTCGTCCAACTACACCGAGATCATCTACGAGCTCCTCGAGGAGTCCCAGAACC
AGCAGGAGAAGAACGAGCAGGATCTGCTCGCGCTGGACCGCTGGAACTCCCTGTGGAACTGGTTCAACATCACCAAGTGGCTGTGGTACA
TCAAGATCTTCATCATGATCGTGGGCGGCCTGATCGGCCTGCGCATCATCTTCGCCGTGCTGTCGCTGGTGAACCGCGTGCGCCAGGGCTGATGAGaattcggtcaccggg
tcccggatccagatctgctgtgccttt
>HV1300700
gtcgacaagaagccaccATGCGCGTGATGGGCATCCAGCGCAACTACACGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGTGAACGCCACCGCGTCCAACTCCTCTATCATCGAGGGGATGAACT
CGTCCATCCTCGAGGGCATGAAGAACTGCTCCTTCAACATCACGACGGAGCTGCGCGACAAGCGCGAGAAGAAGAACGCCCTGTTCTACA Fig. 21 cont.
AGCTGGACATCGTGCAGCTGGGGGGCAACTCCTCGCAGTACAGGCTGATCAACTGCAACACCTCCGTCATCACGCAGGCGTGCCCCAAGG
TGTCCTTCGACCCCATCCCCATCCACTACTGCGCCCCCGCCGGCTACGCCATCCTGAAGTGCAACAACAAGACCTTCAACGGCACCGGCC
CGTGCAACAACGTGTCCACCGTGCAGTGCACGCACGGGATCAAGCCCGTGGTGTCCACGCAGCTGCTCCTGAACGGGTCGCTGGCCGAGG
GCGAGATCATCATCCGGTCGAAGAACATCACGGACAACGGGAAGACCATCATCGTGCACCTGAACGAGTCCGTGAAGATCGAGTGCACCC
GCCCGTCGAACAACACGCGCACCTCCATCCGGATCGGCCCTGGCCAGGCCTTCTACGCCACCGGCCAGGTGATCGGCGACATCCGCGAGG
CGCACTGCAACATCAGCGAGTCCAAGTGGAACGAGACCCTGCAGCGCGTGTCCGAGAAGCTGAAGGAGTACTTCCCCGACAAGAACATCA
CCTTCCAGCCGTCGTCCGGCGGCGACCTCGAGATCACCACGCACTCCTTCAACTGCGGTGGCGAGTTCTTCTACTGCAACACGTCGTCGC
TGTTCAACCGCACCTACATGGCCAACTCCACCGACATGGCCAACTCCACCGAGACCAACTCCACGCGCATCATCACGATCCGCTGCCGCA
TCAAGCAGATCATCAACATGTGGCAGGAGGTGGGCCGCGCCATGTACGCACCGCCCATCGCCGGCAACATCACCTGCATCTCCAACATCA
CCGGCCTCCTGCTGACCCGCGACGGCGGCGAGAACAACACGGAGACCTTCGAGACGTTCAGGCCAGGCGGAGGCAACATGAAGGACAACT
GGCGCTCCGAGCTGTACAAGTACAAGGTGGTGGAGGTGAAGCCCCTGGGCGTGGCACCCACCAACGCCcgcaggcgcgtcgtggagcgcg
agaagcgcGCCGTGGGCATGGGCGCCGTGTTCCTGGGCTTCCTGGGCGCTGCGGGCTCCACCATGGGTGCCGCGTCCATCACCCTGACCG
TGCAGGCCCGCCAGCTGCTCTCCGGCATCGTGCAGCAGCAGTCCAACCTCCTGAAGGCCATCGAGGCCCAGCAGCACATGCTGAAGCTGA
CCGTGTGGGGCATCAAGCAGCTGCAGGCCAGGGTGCTCGCGCTCGAGCGCTACCTGAAGGACCAGCAGCTGCTCGGCATGTGGGGCTGCT
CCGGCAAGCTGATCTGCACCACCAACGTGTACTGGAACTCGTCCTGGTCCAACAAGACCTACGGCGACATCTGGGACAACATGACCTGGA
TGCAGTGGGAGCGCGAGATCTCCAACTACACCGAGCTGATCTACGAGCTCCTCGAGGAGTCCCAGAACCAGCAGGAGAAGAACGAGCAGG
ATCTGCTCGCGCTGGACCGCTGGAACTCCCTCTGGGACTGGTTCAACATCACCAACTGGCTGTGGTACATCAAGATCTTCATCATGATCG
TGGGCGGCCTGATCGGCCTGCGCATCATCTTCGCCGTGCTGTCGCTGGTGAACCGCGTGCGCCAGGGCTGATGAGaattcggtcaccagg
acccggatccagatctgctgtgcctt
>HV1300701
gtcgacaagaagccaccATGCGCGTGATGGGCATCCAGCGCAACTACCCGCAGTGGTGGATCTGGTCGATGCTGGGCCTGTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCGACGCCACCGCGTCCAACGCAACCGCGAGCAACGCCACGGCGTCGAACG
CGACCGCGTCGAACTCCTCCATCATCATCGAGGGCATGAAGAACTGCTCCTTCAACATCACGGACGGAGCTGCGCGACAAGCGCGAGAAGA
AGAACGCCCTGTTCTACAAGCTGGACATCGTGCAGCTGGACGGCAACTCCTCGCAGTACAGGCTGATCAACTGCAACACCTCCGTCATCA
CGCAGGCGTGCCCCAAGGTGTCCTTCGACCCCATCCCCATCCACTACTGCGCCCCCGCCGGCTACGCCATCCTGAAGTGCAACAACAAGA
CCTTCAACGGCACCGGCCCGTGCAACAACGTGTCCACCGTGCAGTGCACGCACGGGATCAAGCCCGTGGTGTCCACGCAGCTGCTCCTGA
ACGGGTCGCTGGCCGAGGGCGAGATCATCATCCGGTCCAAGAACATCACGGACAACGGGAAGACCATCATCGTGCACCTGAACGAGTCCG
TGAAGATCGAGTGCACCCGCCCGAGCAACAACACGCGCACCTCCATCCGGATCGGCCCTGGCCAGGCCTTCTACGCCACCGGCCAGGTGA
TCGGCGACATCCGCGAGGCGCACTGCAACATCAGCGAGTCCAAGTGGAACGAGACCCTGCAGCGCGTGTCCAAGAAGCTGAAGGAGTACT
TCCCCCAGAAGAACATCACCTTCCAGCCGTCGTCCGGCGGCGACCTCGAGATCACCACGCACTCCTTCAACTGCGGTGGCGAGTTCTTCT
ACTGCAACACGTCGTCGCTGTTCAACCGCACCTACATGGCCAACTCCACCGACATGGCCAACTCCACCGAGACCAACTCCACCATCACGA
TCCGCTGCCGCATCAAGCAGATCATCAACATGTGGCAGGAGGTGGGCCGCGCCATGTACGCACCGCCCATCGCCGGCAACATCACCTGCA
TCTCCAACATCACCGGCCTCCTGCTGACCCGCGACGGCGGCAAGAACAACACGGAGACCTTCGAGACGTTCAGGCCAGGCGGAGGCAACA
TGAAGGACAACTGGCGCTCCGAGCTGTACAAGTACAAGGTGGTGGAGGTGAAGCCCCTGGGCGTGGCACCCACCAACGCCCGCAGGCGCG
TCGTGGAGCGCGAGAAGCGCGCCGTGGGCATGGGCGCCGTGTTCCTGGGCTTCCTGGGCGCTGCGGGCTCCACCATGGGTGCCGCGTCCA
TCACCCTGACCGTGCAGGCCCGCCAGCTGCTCTCCGGCATCGTGCAGCAGCAGTCCAACCTCCTGAAGGCCATCGAGGCCCAGCAGCACA
TGCTGAAGCTGACCGTGTGGGGCATCAAGCAGCTGCAGGCCAGGGTGCTCGCGCTCGAGCGCTACCTGAAGGACCAGCAGCTGCTCGGCA
TGTGGGGCTGCTCCGGCAAGCTGATCTGCACCACCAACGTGTACTGGAACTCGTCCTGGTCCAACAAGACCTACGGCGACATCTGGGACA
ACATGACCTGGATGCAGTGGGAGCGCGAGATCTCCAACTACACCGAGATGATCTACGAGCTCCTCGAGGAGTCCCAGAACCAGCAGGAGA
AGAACGAGCAGGATCTGCTCGCGCTGGACCGCTGGAACTCCCTGTGGAACTGGTTCAACATCACCAAGTGGCTGTGGTACATCAAGATCT
TCATCATGATCGTGGGCGGCCTGATCGCCTGCGCATCATCTTCGCCGTGCTGTCGCTGGTGAACCGCGTGCGCCAGGGCTGATGAGaat
tcggtcaccaggtcccggatccagatctgctgtgcctt
>HV1300702
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCGACGCCACCGCGTCCAACGCGACGGCGATCAACATCTCCATCATCGAGG
AGATGAAGAACTGCTCCTTCAACATCACGACGGAGCTGCGCGACAAGCGCGAGAAGAAGAACGCCCTGTTCTACAAGCTGGACATCGTGC
AGCTGGACGGCAACTCCTCGCAGCACAGGCTGATCAACTGCAACACCTCCGTCATCACGCAGGCGTGCCCCAAGGTGTCCTTCGACCCCA
TCCCCATCCACTACTGCGCCCCCGCCGGCTACGCCATCCTGAAGTGCAACAACAAGACCTTCAACGGCACCGGCCCGTGCAACAACGTGT
CCACCGTGCAGTGCACGCACGGGATCAAGCCCGTGGTGTCCACGCAGCTGCTCCTGAACGGGTCGCTGGCCGAGGGCGAGATCATCATCC
GGTCGAAGAACATCACGGACAACGGGAAGACCATCATCGTGCACCTGAACGAGTCCGTGAAGATCGAGTGCACCCGCCCGAGCAACAACA
CGCGCACCTCCATCCGGATCGGCCCTGGCCAGGCCTTCTACGCCACCGGCCAGGTGATCGGCAACATCCGCGAGGCGCACTGCAACATCT Fig. 21 cont.
CCGAGTCCAAGTGGAACGAGACCCTGCAGCGCGTGTCCGAGAAGCTGAAGGAGTACTTCCCCCACAAGAACATCACCTTCCAGCCGTCGT
CCGGCGGCGACCTCGAGATCACCACGCACTCCTTCAACTGCGGTGGCGAGTTCTTCTACTGCAACACGTCGTCGCTGTTCAACCGCACCT
ACATGGCCACCTCCACCGACATGGCCAACTCCACCGAGACCAACTCCACGCGCATCATCACGATCCGCTGCCGCATCAAGCAGATCATCA
ACATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAAGAACGACACCGACACGGAGACCTTCAGGCCAGAGGGAGGCAACATGAAGGACAACTGGCGCTCCGAGCTGTACA
AGTACAAGGTGGTGGAGGTGAAGCCCCTGGGCGTGGCACCCACCAACGCCCGCAGGCGCGTCGTGGAGCGCGAGAAGCGCGCCGTGGGCA
TGGGCGCCGTGTTCCTGGGCTTCCTGGGCGCTGCGGGCTCCACCATGGGTGCCGCGTCCATCACCCTGACCGTGCAGGCCCGCCAGCTGC
TCTCCGGCATCGTGCAGCAGCAGTCCAACCTCCTGAAGGCCATCGAGGCCCAGCAGCACATGCTGAAGCTGACCGTGTGGGGCATCAAGC
AGCTGCAGGCCAGGGTGCTCGCGCTCGAGCGCTACCTGAAGGACCAGCAGCTGCTCGGCATGTGGGGCTGCTCCGGCAAGCTGATCTGCA
CCACCAACGTGTACTGGAACTCGTCCTGGTCCAACAAGACCTACGGCGACATCTGGGACAACATGACCTGGATGCAGTGGGAGCGCGAGA
TCTCCAACTACACCGACATCATCTACGAGCTCCTCGAGGAGTCCCAGAACCAGCAGGAGAAGAACGAGCAGGATCTGCTCGCGCTGGACC
GCTGGAACTCCCTGTGGAACTGGTTCAACATCACCAACTGGCTGTGGTACATCAAGATCTTCATCATGATCGTGGGCGGCCTGATCGGCC
TGCGCATCATCTTCGCCGTGCTGTCGCTGGTGAACCGCGTGCGCCAGGGCTGATGAGaattcggtcaccgggacctggatccagatctgc
tgtgcctt
>HV1300703
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGGACTGCATCAACGCCACCAACGCGACGGCGTCGAACTCCTCCATCCTGAGGGGATGA
AGAACTGCTCCTTCAACATCACGACGGAGCTGCGCGACAAGCGCGAGAAGAAGAACGCCCTGTTCTACAAGCTGGACATCGTGCAGCTGG
GGGGCAACTCCTCGCAGTACAGGCTGATCAACTGCAACACCTCCGTCATCACCAGGCGTGCCCCAAGGTGCCTTCGACCCCATCCCCA
TCCACTACTGCGCCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACGGGAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCGACATCCGCGAGGCGCACTGCAACATCTCCGAGT
CCAAGTGGAACGAGACCCTGCAGCGCGTGTCCAAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
TGAACTCCACCGACATGGCCAACTCCACCGAGACCAACTCCACGCGCACCATCACGATCCGCTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCGAGAACAACACCGAGACGTTCGAGACCTTCAGGCCAGGGGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTCGTGGAGCGCGAGAAGCGCGCCGTGGGCATGG
GCGCCGTGTTCCTGGGCTTCCTGGGCGCTGCGGGCTCCACCATGGGTGCCGCGTCCATCACCCTGACCGTGCAGGCCCGCCAGCTGCTCT
CCGGCATCGTGCAGCAGCAGTCCAACCTCCTGAAGGCCATCGAGGCCCAGCAGCACATGCTGAAGCTGACCGTGTGGGGCATCAAGCAGC
TGCAGGCCAGGGTGCTCGCGCTCGAGCGCTACCTGAAGGACCAGCAGCTGCTCGGCATGTGGGGCTGCTCCGGCAAGCTGATCTGCACCA
CCAACGTGTACTGGAACTCGTCCTGGTCCAACAAGACCTACGGCGACATCTGGGACAACATGACCTGGATGCAGTGGGAGCGCGAGATCT
CCAACTACACCGAGCTCATCCTACGAGCTCCTCGAGGAGTCCCAGAACCAGCAGGAGAAGAACGAGCAGGATCTGCTCGCGCTGGACCGCT
GGAACTCCCTGTGGAACTGGTTCAACATCACCAACTGGCTGTGGTACATCAAGATCTTCATCATGATCGTGGGCGGCCTGATCGGCCTGC
GCATCATCTTCGCCGTGCTGTCGCTGGTGAACCGCGTGCGCCAGGGCTGATGAGaattcggtaaccgggtcccggatccagatctgctgt
gcctt
>HV1300704
gtcgacaagaagccaccATGCGCGTGATGGGCCGCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGACGCCCT
GCGTGAAGCTGACCCCGCTGTGCGTGACCCTGAACTGCACCGACGCACCGCATCCAACGCGACGGCTTCCAACGCCACGGCGTCGAACG
CGACAGCGTCGAACTCGTCTATCGAGGGGATGAAGAACTGCTCCTTCAACATCACGACGGACTGCGACAAGCGCGAGAAGAAGAACGAAC
CCCTGTTCTACAAGCTGGACATCGTCGAGCTGGACGGCAACTCCTCGCAGTACAGGCTGATCAACTGCAACACCTCCGTCATCACGCAGG
CGTGCCCCAAGGTGTCCTTCGACCCCATCCCCATCCACTACTGCGCCCCCGCCGGCTACGCCATCCTGAAGTGCAACAACAAGACCTTCA
ACGGCACCGGCCCGTGCAACAACGTGTCCACCGTGCAGTGCACGCACGGGATCAAGCCCGTGGTGTCCACGCAGCTGCTCCTGAACGGGT
CGCTGGCCGAGGGCGAGATCATCATCCGGTCGAAGAACATCACGGACAACGGGAAGACCATCATCGTGCACCTGAACGAGTCCGTGAAGA
TCGAGTGCACCCGCCCGAGCAACAACACGCGCACCTCCATCCGGATCGGCCCTGGCCAGGCCTTCTACGCCACCGGCCAGGTGATCGGCG
ACATCCGCGAGGCGCACTGCAACATCTCCGAGTCCAAGTGGAACGAGACCCTGCAGCGCGTGTCCGAGAAGCTGAAGGAGTACTTCCCCA
ACAAGAACATCACCTTCCAGCCGTCGTCCGGCGGCGACCTCGAGATCACCACGCACTCCTTCAACTGCGGTGGCGAGTTCTTCTACTGCA
ACACGTCGTCGCTGTTCAACCGCACCTACATGGCCAACTCCACCGACATGGCCAACTCCACCGAGACCAACTCCACGCGCATCATCACGA
TCCGCTGCCGCATCAAGCAGATCATCAACATGTGGCAGGAGGTGGGCCGCGCCATGTACGCACCGCCCATCGCCGGCAACATCACCTGCA
TCTCCAACATCACCGGCCTCCTGCTGACCCGCGACGGCGGCAAGAACAACACCGAGACGTTCGAGACCTTCAGGCCAGGGGGAGGCAACA

Fig. 21 cont.
```
TGAAGGACAACTGGCGCTCCGAGCTGTACAAGTACAAGGTGGTGGAGGTGAAGCCCCTGGGCGTGGCACCCACCAACGCCCGCAGGCGCG
TCGTGGAGCGCGAGAAGCGCGCCGTGGGCATGGGCGCCGTGTTCCTGGGCTTCCTGGGCGCTGCGGGCTCCACCATGGGTGCCGCGTCCA
TCACCCTGACCGTGCAGGCCCGCCAGCTGCTCTCCGGCATCGTGCAGCAGCAGTCCAACCTCCTGAAGGCCATCGAGGCCCAGCAGCACA
TGCTGAAGCTGACCGTGTGGGGCATCAAGCAGCTGCAGGCCAGGGTGCTCGCGCTCGAGCGCTACCTGAAGGACCAGCAGCTGCTCGGCA
TGTGGGGCTGCTCCGGCAAGCTGATCTGCACCACCAACGTGTACTGGAACTCGTCCTGGTCCAACAAGACCTACGGCGACATCTGGGACA
ACATGACCTGGATGCAGTGGGAGCGCGAGATCTCCAACTACACCGAGATGATCTACGAGCTCCTCGAGGAGTCCCAGAACCAGCAGGAGA
AGAACGAGCAGGATCTGCTCGCGCTGGACCGCTGGAACTCCCTGTGGAACTGGTTCAACATCACCAAGTGGCTGTGGTACATCAAGATCT
TCATCATGATCGTGGGCGGCCTGATCGGCCTGCGCATCATCTTCGCCGTGCTGTCGCTGGTGAACCGCGTGCGCCAGGGCTGATGAGaat
tcggtaaccaggacccggatccagatctgctgtgccctt
>HV1300705
gtcgacaagaagccaccATGCGCGTGACGGGCATCCAGCGCAACTACCCGCAGTGGTGGATCTGGTCGATGCTGGGCCTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGCGGACCAGATGCACGAGGACGTGATCTCCCTGTGGGACCAGTCCCTGAAGCCCT
GCGTGAAGCTGACCCCGCTGTGCGTGACCCTGAACTGCATCGACGCCAACGCGACCGCGTCCAACGCGACGGCATCCAACTCGTCCATCA
TCGAGGGGATGAAGAACTGCTCCTTCAACATCACGACGGAGCTGCGCGACAAGATCGAGAAGAAGAACGCCCTGTTCTACAAGCTGGACA
TCGTGCAGCTGGACGGCAACTCCTCGCAGTACAGGCTGATCAACTGCAACACCTCCGTCATCACGCAGGCGTGCCCCAAGGTGTCCTTCG
ACCCCATCCCCATCCACTACTGCGCCCCCGCCGGCTACGCCATCCTGAAGTGCAACAACAAGACCTTCAACGGCACCGGCCCGTGCAACA
ACGTGTCCACCGTGCAGTGCACGCACGGGATCAAGCCCGTGGTGTCCACGCAGCTGCTCCTGAACGGGTCGCTGGCCGAGGGCGAGATCA
TCATCCGGTCGGAGAACATCACGAACAGCGCGAAGACCATCATCGTGCACCTGAACGAGTCCGTGAAGATCGAGTGCACCCGCCCGAGCA
ACAACACGCGCACCTCCATCCGGATCGGCCCTGGCCAGGCCTTCTACGCCACCGGCCAGGTGATCGGCGACATCCGCAAGGCGCACTGCA
ACATCTCCGAGTCCAAGTGGAACGAGACCCTGCAGCGCGTGTCCAAGAAGCTGAAGGAGTACTTCCCCCACAAGAACATCACCTTCCAGC
CGTCGTCCGGCGGCGACCTCGAGATCACCACGCACTCCTTCAACTGCGGTGGCGAGTTCTTCTACTGCAACACGTCGTCGCTGTTCAACC
GCACCTACATGGCCAACTCCACCGAGACCAACTCCACGCGCACGATCACGCTCCACTGCCGCATCAAGCAGATCATCAACATGTGGCAGG
AGGTGGGCCGCGCCATGTACGCACCGCCCATCGCCGGCAACATCACCTGCATCTCCAACATCACCGGCCTCCTGCTGACCCGCGACGGCG
GCAACAACAACACCACGGAGACCTTCAGGCCAGGGGGAGGCAACATGAAGGACAACTGGCGCTCCGAGCTGTACAAGTACAAGGTGGTGG
AGATCAAGCCCCTGGGCGTGGCACCCACCAACGCCCGCAGGCGCGTCGTGGAGCGCGAGAAGCGCGCCGTGGGCATGGGCGCCGTGTTCC
TGGGCTTCCTGGGCGCTGCGGGCTCCACCATGGGTGCCGCGTCCATCACCCTGACCGTGCAGGCCCGCCAGCTGCTCTCCGGCATCGTGC
AGCAGCAGTCCAACCTCCTGAAGGCCATCGAGGCCCAGCAGCACATGCTGAAGCTGACCGTGTGGGGCATCAAGCAGCTGCAGGCCAGGG
TGCTCGCGCTCGAGCGCTACCTGAAGGACCAGCAGCTGCTCGGCATGTGGGGCTGCTCCGGCAAGCTGATCTGCACCACCAACGTGTACT
GGAACTCGTCCTGGTCCAACAAGACCTACGGCGACATCTGGGACAACATGACCTGGATGCAGTGGGAGCGCGAGATCTCCGACTACACCG
AGATCATCTACGAGCTCCTCGAGGAGTCCCAGAACCAGCAGGAGAAGAACGAGCAGGATCTGCTCGCGCTGGACCGCTGGAACTCCCTGT
GGAACTGGTTCAACATCACCAACTGGCTGTGGTACATCAAGATCTTCATCATGATCGTGGGCGGCCTGATCGGCCTGCGCATCATCTTCG
CCGTGCTGTCGCTGGTGAACCGCGTGCGCCAGGGCTGATGAGaattcggtaaccaggtcccggatccagatctgctgtgccctt
>HV1300706
gtcgacaagaagccaccATGCGCGTGATGGGCATCCAGCGCAACTACCCGCAGTGGTGGATCTGGTCGATGCTGGGCCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCGACGCCACCGCGTCCAACGCGACGGCGATCAACATCTCCATCATCGAGG
AGATGAAGAACTGCTCCTTCAACATCACGACGGAGCTGCGCGACAAGCGCGAGAAGAAGAACGCCCTGTTCTACAAGCTGGACATCGTGC
AGCTGGACGGCAACTCCTCGCAGCACAGGCTGATCAACTGCAACACCTCCGTCATCACGCAGGCGTGCCCCAAGGTGTCCTTCGACCCCA
TCCCCATCCACTACTGCGCCCCCGCCGGCTACGCCATCCTGAAGTGCAACAACAAGACCTTCAACGGCACCGGCCCGTGCAACAACGTGT
CCACCGTGCAGTGCACGCACGGGATCAAGCCCGTGGTGTCCACGCAGCTGCTCCTGAACGGGTCGCTGGCCGAGGGCGAGATCATCATCC
GGTCGAAGAACATCACGGACAACGGGAAGACCATCATCGTGCACCTGAACGAGTCCGTGAAGATCGAGTGCACCCGCCCGAGCAACAACA
CGCGCACCTCCATCCGGATCGGCCCTGGCCAGGCCTTCTACGCCACCGGCCAGGTGATCGGCAACATCCGCGAGGCGCACTGCAACATCT
CCAAGTCCAAGTGGAACGAGACCCTGCAGCGCGTGTCCGAGAAGCTGAAGGAGTACTTCCCCCACAAGAACATCACCTTCCAGCCGTCGT
CCGGCGGCGACCTCGAGATCACCACGCACTCCTTCAACTGCGGTGGCGAGTTCTTCTACTGCAACACGTCGTCGCTGTTCAACCGCACCT
ACATGGCCACCTCCACCGACATGGCCAACTCCACCGAGACCAACTCCACGCGCATCATCACGATCCGCTGCCGCATCAAGCAGATCATCA
ACATGTGGCAGGAGGTGGGCCGCGCCATGTACGCACCGCCCATCGCCGGCAACATCACCTGCATCTCCAACATCACCGGCCTCCTGCTGA
CCCGCGACGGCGGCAACAACAACACCACGGAGACCTTCAGGCCAGAGGGAGGCAACATGAAGGACAACTGGCGCTCCGAGCTGTACA
AGTACAAGGTGGTGGAGGTGAAGCCCCTGGGCGTGGCACCCACCAACGCCCGCAGGCGCGTCGTGGAGCGCGAGAAGCGCGCCGTGGGCA
TGGGCGCCGTGTTCCTGGGCTTCCTGGGCGCTGCGGGCTCCACCATGGGTGCCGCGTCCATCACCCTGACCGTGCAGGCCCGCCAGCTGC
TCTCCGGCATCGTGCAGCAGCAGTCCAACCTCCTGAAGGCCATCGAGGCCCAGCAGCACATGCTGAAGCTGACCGTGTGGGGCATCAAGC
AGCTGCAGGCCAGGGTGCTCGCGCTCGAGCGCTACCTGAAGGACCAGCAGCTGCTCGGCATGTGGGGCTGCTCCGGCAAGCTGATCTGCA
CCACCAACGTGTACTGGAACTCGTCCTGGTCCAACAAGACCTACGGCGACATCTGGGACAACATGACCTGGATGCAGTGGGAGCGCGAGA
TCTCCAACTACACCGACATCATCTACGAGCTCCTCGAGGAGTCCCAGAACCAGCAGGAGAAGAACGAGCAGGATCTGCTCGCGCTGGACC
```

Fig. 21 cont.
GCTGGAACTCCCTGTGGAACTGGTTCAACATCACCAACTGGCTGTGGTACATCAAGATCTTCATCATGATCGTGGGCGGCCTGATCGGCC
TGCGCATCATCTTCGCCGTGCTGTCGCTGGTGAACCGCGTGCGCCAGGGCTGATGAGaattcggtaaccgggacctggatccagatctgc
tgtgccctt
>HV1300707
gtcgacaagaagccaccATGCGCGTGATGGGCATCCAGAAGAACTGCCCGCAGTGGTGGATCTGGTCGATGCTGGGCCTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACGGACGCCAACGCAACCGCGTCCAACTCGTCCATCATCAAGGGGATGAACT
CGTCCATGATCGAGGAGATGAAGAACTGCTCCTTCAACATCACGACGGAGCTGCGCGACAAGCGCGAGAAGAAGAACGCCCTGTTCTACA
AGCTGGACATCGTGCAGCTGGACGGCAACTCCTCGCAGTACAGGCTGATCAACTGCAACACCTCCGTCATCACGCAGGCGTGCCCCAAGG
TGTCCTTCGACCCCATCCCCATCCACTACTGCGCCCCGCCGGCTACGCCATCCTGAAGTGCAACAACAAGACCTTCAACGGCACCGGCC
CGTGCAACAACGTGTCCACCGTGCAGTGCACGCACGGGATCAAGCCCGTGGTGTCCACGCAGCTGCTCCTGAACGGGTCGCTGGCCGAGG
GCGAGATCATCATCCGGTCGAAGAACATCACGGACAACGGGAAGACCATCATCGTGCACCTGAACGAGTCCGTGAAGATCGAGTGCACCC
GCCCGAGCAACAACACGCGCACCTCCATCCGGATCGGCCCTGGCCAGGCCTTCTACGCCACCGGCCAGGTGATCGGCGACATCCGCGAGG
CGCACTGCAACATCTCCGAGTCCAAGTGGAACGAGACCCTGCAGCGCGTGTCCAAGAAGCTGAAGGAGTACTTCCCCCAGAAGGACATCA
CCTTCCAGCCGTCGTCCGGCGGCGACCTCGAGATCACCACGCACTCCTTCAACTGCGGTGGCGAGTTCTTCTACTGCAACACGTCGTCGC
TGTTCAACCGCACCTACATGGCCACCTCCACCGACATGGCCAACTCCACCGAGACCAACTCCACGCGCATCATCACGATCCGCTGCCGCA
TCAAGCAGATCATCAACATGTGGCAGGAGGTGGGCCGCGCCATGTACGCACCGCCCATCGCCGGCAACATCACCTGCATCTCCAACATCA
CCGGCCTCCTGCTGACCCGCGACGGCGGCGAGAACGACACCGACACGGAGACCTTCAGGCCAGAGGGAGGCAACATGAAGGACAACTGGC
GCTCCGAGCTGTACAAGTACAAGGTGGTGGAGGTGAAGCCCCTGGGCGTGGCACCCACCAACGCCCGCAGGCGCGTCGTGGAGCGCGAGA
AGCGCGCCGTGGGCATGGGCGCCGTGTTCCTGGGCTTCCTGGGCGCTGCGGGCTCCACCATGGGTGCCGCGTCCATCACCCTGACCGTGC
AGGCCCGCCAGCTGCTCTCCGGCATCGTGCAGCAGCAGTCCAACCTCCTGAAGGCCATCGAGGCCCAGCAGCACATGCTGAAGCTGACCG
TGTGGGGCATCAAGCAGCTGCAGGCCAGGGTGCTCGCGCTCGAGCGCTACCTGAAGGACCAGCAGCTGCTCGGCATGTGGGGCTGCTCCG
GCAAGCTGATCTGCACCACCAACGTGTACTGGAACTCGTCCTGGTCCAACAAGACCTACGGCGACATCTGGCAACATGACCTGGATGC
AGTGGGAGCGCGAGATCTCCAACTACACCGACATCATCTACGAGCTCCTCGAGGAGTCCCAGAACCAGCAGGAGAAGAACGAGCAGGATC
TGCTCGCGCTGGACCGCTGGAACTCCCTGTGGAACTGGTTCAACATCACCAACTGGCTGTGGTACATCAAGATCTTCATCATGATCGTGG
GCGGCCTGATCGGCCTGCGCATCATCTTCGCCGTGCTGTCGCTGGTGAACCGCGTGCGCCAGGGCTGATGAGaattcggtaaccgggtcc
tggatccagatctgctgtgccctt
>HV1300708
gtcgacaagaagccaccATGCGCGTGATGGGCATCCAGCGCTCGTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGCGCCTGACCCCGCTGTGCGTGACCCTGAACTGCATCAACGCCACCAACGCGACGGCGTCGAACTCCTCCATCCTCGAGGGGATGA
AGAACTGCTCCTTCAACATCACGACGGAGCTGCGCGACAAGCGCGAGAAGAAGAACGCCCTGTTCTACAAGCTGGACATCGTGCAGCTGG
ACGGCAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACGGGAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCGACATCCGCGAGGCGCACTGCAACATCTCCGAGT
CCAAGTGGAACGAGACCCTGCAGCGCGTGTCCGAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGAACCTGTTCAACCGCACCTACATGG
TGAACTCCACCGACATGGCCAACTCCACCGAGACCAACTCCACGCGCACCATCACGATCAGCTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAAGAACGACACCGACACGGAGACCTTCAGGCCAGAGGGAGGCAACATGAAGGACAACTGGCGCTCCGAGCTGTACAAGTACA
AGGTGGTGGAGGTGAAGCCCCTGGGCGTGGCACCCACCAACGCCCGCAGGCGCGTCGTGGAGCGCGAGAAGCGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
ACGTGTACTGGAACTCGTCCTGGTCCAACAAGACCTACGGCGACATCTGGGACAACATGACCTGGATGCAGTGGGAGCGCGAGATCTCCA
ACTACACCGACATCATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACCGCGTGCGCCAGGGCTGATGAGaattcggttaccgggtcccggatccagatctgctgtgcc
tt
>HV1300709

Fig. 21 cont.

```
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCAACGCCACCAACGCGACGGCGTCGAACTCCTCCATCCTCGAGGGGATGA
AGAACTGCTCCTTCAACATCACGACGGAGCTGCGCGACAAGCGCGAGAAGAAGAACGCCCTGTTCTACAAGCTGGACATCGTGCAGCTGG
ACGGCAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCCA
AGAACATCACGGACAACGGGAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCAACATCCGCGAGGCGCACTGCAACATCTCCGAGT
CCAAGTGGAACGAGACCCTGCACGCGTGTCCGAGAAGCTGAAGGAGTACTTCCCCCAGAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
CGACCTCCACCGACATGGCCAACTCCACCGAGACCAACTCCACGCGCATCATCACGATCCGCTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAACGACACCGACACGGAGACCTTCAGGCCAGAGGGAGGCAACATGAAGGACAACTGGCGCTCCGAGCTGTACAAGTACAAGG
TGGTGGAGGTGAAGCCCCTGGGCGTGGCACCCACCAACGCCcgcaggcgcgtcgtggagcgcgagaagcgcGCCGTGGGCATGGGCGCCG
TGTTCCTGGGCTTCCTGGGCGCTGCGGGCTCCACCATGGGTGCCGCGTCCATCACCCTGACCGTGCAGGCCCGCCAGCTGCTCTCCGGCA
TCGTGCAGCAGCAGTCCAACCTCCTGAAGGCCATCGAGGCCCAGCAGCACATGCTGAAGCTGACCGTGTGGGGCATCAAGCAGCTGCAGG
CCAGGGTGCTCGCGCTCGAGCGCTACCTGAAGGACCAGCAGCTGCTCGGCATGTGGGGCTGCTCCGGCAAGCTGATCTGCACCACCAACG
TGTACTGGAACTCGTCCTGGTCCAACAAGACCTACGGCGACATCTGGGACAACATGACCTGGATGCAGTGGGAGCGCGAGATCTCCAACT
ACACCGACATCATCTACGAGCTCCTCGAGGAGTCCCAGAACCAGCAGGAGAAGAACGAGCAGGATCTGCTCGCGCTGGACCGCTGGAACT
CCCTGTGGAACTGGTTCAACATCACCAACTGGCTGTGGTACATCAAGATCTTCATCATGATCGTGGGCGGCCTGATCGGCCTGCGCATCA
TCTTCGCCGTGCTGTCGCTGGTGAACCGCGTGCGCCAGGGCTGATGAGaattcggttaccaggacccggatccagatctgctgtgcctt
>HV1300710
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCAACGCCACCAACGCGACGGCGTCGAACTCCTCCATCCTCGGCGGGATGA
AGAACTGCTCCTTCAACATCACGACGGAGCTGCGCGACAAGCGCGAGAAGAAGAACGCCCTGTTCTACAAGCTGGACATCGTGCAGCTGG
ACGGCAACTCCTCGCAGTACAGGCTGATCAACTGCAACACCTCCGCGATCACGCAGGCGTGCCCCAAGGTGTCCTTCGACCCCATCCCCA
TCCACTACTGCGCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACGGGAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCGACATCCGCGAGGCGCACTGCAACATCTCCGAGT
CCAAGTGGAACGAGACCCTGCAGCGCGTGTCCGAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
CGAACTCCACCGACATGGCCAACTCCACCGAGACCAACTCCACGCGCATCATCACGATCCGCTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAAGAACGACACCGACACGGAGACCTTCAGGCCAGAGGGAGGCAACATGAAGGACAACTGGCGCTCCGAGCTGTACAAGTACA
AGGTGGTGGAGGTGAAGCCCCTGGGCGTGGCACCCACCAACGCCCGCAGGCGCGTCGTGGAGCGCGAGAAGCGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
ACGTGTACTGGAACTCGTCCTGGTCCAACAAGACCTACGGCGACATCTGGGACAACATGACCTGGATGCAGTGGGAGCGCGAGATCTCCA
ACTACACCGAGCTGATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACCGCGTGCGCCAGGGCTGATGAGaattcggttaccaggtcccggatccagatctgctgtgcc
tt
>HV1300711
gtcgacaagaagccaccATGCGCGTGCGCGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGCGCCTGACCCCGCTGTGCGTGACCCTGAACTGCATCAACGCCACCAACGCGACGGCGTCGAACTCCTCCATCCTCGAGGGGATGA
AGAACTGCTCCTTCAACATCACGACGGAGCTGCGCGACAAGCGCGAGAAGAAGAACGCCCTGTTCTACAAGCTGGACATCGTGCAGCTGG
```

Fig. 21 cont.

```
ACGGCAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACGGGAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCGACATCCGCGAGGCGCACTGCAACATCTCCGAGT
CCAAGTGGAACGAGACCCTGCAGCGCGTGTCCGAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
CGAACTCCACCGACATGGCCAACTCCACCGAGACCAACTCCACGCGCATCATCACGCTGCACTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAACGACACCGACACGGAGACCTTCAGGCCAGAGGGAGGCAACATGAAGGACAACTGGCGCTCCGAGCTGTACAAGTACAAGG
TGGTGGAGGTGAAGCCCCTGGGCGTGGCACCCACCAACGCCCGCAGGCGCGTCGTGGAGCGCGAGAAGCGCGCCGTGGGCATGGGCGCCG
TGTTCCTGGGCTTCCTGGGCGCTGCGGGCTCCACCATGGGTGCCGCGTCCATCACCCTGACCGTGCAGGCCCGCCAGCTGCTCTCCGGCA
TCGTGCAGCAGCAGTCCAACCTCCTGAAGGCCATCGAGGCCCAGCAGCACATGCTGAAGCTGACCGTGTGGGGCATCAAGCAGCTGCAGG
CCAGGGTGCTCGCGCTCGAGCGCTACCTGAAGGACCAGCAGCTGCTCGGCATGTGGGGCTGCTCCGGCAAGCTGATCTGCACCACCAACG
TGTACTGGAACTCGTCCTGGTCCAACAAGACCTACGGCGACATCTGGGACAACATGACCTGGATGCAGTGGGAGCGCGAGATCTCCAACT
ACACCGACATCATCTACGAGCTCCTCGAGGAGTCCCAGAACCAGCAGGAGAAGAACGAGCAGGATCTGCTCGCGCTGGACCGCTGGAACT
CCCTGTGGAACTGGTTCAACATCACCAACTGGCTGTGGTACATCAAGATCTTCATCATGATCGTGGGCGGCCTGATCGGCCTGCGCATCA
TCTTCGCCGTGCTGTCGCTGGTGAACCGCGTGCGCCAGGGCTGATGAGaattcggttaccgggacctggatccagatctgctgtgcctt
>HV1300712
gtcgacaagaagccaccATGCGCGTGATGGGCATCCAGCGCAACTACCCGCAGTGGTGGATCTGGTCGATGCTGGGCCTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGCGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGCGGACCAGATGCACGAGGACGTGATCTCCCTGTGGGACCAGTCCCTGAAGCCCT
GCGTGAAGCTGACCCCGCTGTGCGTGACCCTGAACTGCACGGACGCCAACGCCACCGCGTCGAACGCCAACGCGACCGCAAGCAACACCA
ACGCGACGGTGTCGAACTCCTCCATCATCGAGGAGATGAAGAACTGCTCCTTCAACATCACGACGGAGCTGCGCGACAAGCGCGAGAAGA
AGTACGCCCTGTTCTACAAGCTGGACATCGTGCAGCTGGACGGCAACTCCTCGCAGTACAGGCTGATCAACTGCAACACCTCCGTCATCA
CGCAGGCGTGCCCCAAGGTGTCCTTCGACCCCATCCCCATCCACTACTGCGCCCCGCCGGCTACGCCATCCTGAAGTGCAACAACAAGA
CCTTCAACGGCACCGGCCCGTGCAACAACGTGTCCACCGTGCAGTGCACGCACGGGATCAAGCCCGTGGTGTCCACGCAGCTGCTCCTGA
ACGGGTCGCTGGCCGAGGGCGAGATCATCATCCGGTCGGAGAACATCACGAACAGCGCGAAGACCATCATCGTGCACCTGAACGAGTCCG
TGAAGATCGAGTGCACCCGCCCGAGCAACAACACGCGCACCTCCATCCGGATCGGCCCTGGCCAGGCCTTCTACGCCACCGGCCAAGTGA
TCGGCGACATCCGCAAGGCGCACTGCAACATCTCCGAGTCCAAGTGGAACGAGACCCTGCAGCGCGTGTCCAAGAAGCTGAAGGAGTACT
TCCCCCACAAGAACATCACCTTCCAGCCGTCGTCCGGCGGCGACCCCGAGATCACCACGCACTCCTTCAACTGCGGTGGCGAGTTCTTCT
ACTGCAACACGTCGTCCCTGTTCAACCGCACCTACATGGCGAACTCCACCGAGACCAACTCCACGCGCACCATCACGCTGCACTGCCGCA
TCAAGCAGATCATCAACATGTGGCAGGAGGTGGGCCGCGCCATGTACGCACCGCCCATCGCCGGCAACATCACCTGCATCTCCAACATCA
CCGGCCTCCTGCTGACCCGCGACGGCGGCAACGACACCGACACGGAGACCTTCAGGCCAGGGGAGGCAACAACACGGAGACCTTCAGGCCAGGCGAGGCAACA
TGAAGGACAACTGGCGCTCCGAGCTGTACAAGTACAAGGTGGTGGAGGTGAAGCCCCTGGGCGTGGCACCCACCAACGCCCGCAGGCGCG
TCGTGGAGCGCGAGAAGCGCGCCGTGGGCATGGGCGCCGTGTTCCTGGGCTTCCTGGGCGCTGCGGGCTCCACCATGGGTGCCGCGTCCA
TCACCCTGACCGTGCAGGCCCGCCAGCTGCTCTCCGGCATCGTGCAGCAGCAGTCCAACCTCCTGAAGGCCATCGAGGCCCAGCAGCACA
TGCTGAAGCTGACCGTGTGGGGCATCAAGCAGCTGCAGGCCAGGGTGCTCGCGCTCGAGCGCTACCTGAAGGACCAGCAGCTGCTCGGCA
TGTGGGGCTGCTCCGGCAAGCTGATCTGCACCACCAACGTGTACTGGAACTCGTCCTGGTCCAACAAGACCTACGGCGACATCTGGGACA
ACATGACCTGGATGCAGTGGGAGCGCGAGATCTCCAACTACACCGACATCATCTACGACCTCCTCGAGGAGTCCCAGAACCAGCAGGAGA
AGAACGAGCAGGATCTGCTCGCGCTGGACCGCTGGAACTCCCTGTGGAACTGGTTCAACATCACCAAGTGGCTGTGGTACATCAAGATCT
TCATCATGATCGTGGGCGGCCTGATCGGCCTGCGCATCATCTTCGCCGTGCTGTCGCTGGTGAACCGCGTGCGCCAGGGCTGATGAGaat
tcggttaccgggtcctggatccagatctgctgtgcctt
>HV1300713
gtcgacaagaagccaccATGCGCGTGATGGGCATCCAGCGCAACTACCCGCAGTGGTGGATCTGGTCGATGCTGGGCCTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAGCGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACGGACGCCAACGCCACCGCGTCGAACAGCTCCATCATCAAGGGGATGAACT
CGTCCATGATCGAGGAGATGAAGAACTGCTCCTTCAACATCACGACGGAGCTGCGCGACAAGCGCGAGAAGAAGAACGCCCTGTTCTACA
AGCTGGACATCGTGCAGCTGGACGGCAACTCCTCGCAGTACAGGCTGATCAACTGCAACACCTCCGTCATCACGCAGGCGTGCCCCAAGG
TGTCCTTCGACCCCATCCCCATCCACTACTGCGCCCCGCCGGCTACGCCATCCTGAAGTGCAACAACAAGACCTTCAACGGCACCGGCC
CGTGCAACAACGTGTCCACCGTGCAGTGCACGCACGGGATCAAGCCCGTGGTGTCCACGCAGCTGCTCCTGAACGGGTCGCTGGCCGAGG
GCGAGATCATCATCCGGTCGGAGAACATCACGAACAGCGCGAAGACCATCATCGTGCACCTGAACGAGTCCGTGAAGATCGAGTGCACCC
GCCCGAGCAACAACACGCGCACCTCCATCCGGATCGGCCCTGGCCAGGCCTTCTACGCCACCGGCCAGGTGATCGGCGACATCCGCAAGG
CGCACTGCAACATCTCCGAGTCCAAGTGGAACGAGACCCTGCAGCGCGTGTCCAAGAAGCTGAAGGAGTACTTCCCCGACCGGAACATCA
```

Fig. 21 cont.
CCTTCCAGCCGTCGTCCGGCGGCGACCCCGAGATCACCACGCACTCCTTCAACTGCGGTGGCAAGTTCTTCTACTGCAACACGTCGTCCC
TGTTCAACCGCACCTACATGGCCAACTCGACGGACATGGCGAACTCCACCGAGACCAACTCCACGCGCATCATCACGATCCGGTGCCGCA
TCAAGCAGATCATCAACATGTGGCAGGAGGTGGGCCGCGCCATGTACGCACCGCCCATCGCCGGCAACATCACCTGCATCTCCAACATCA
CCGGCCTCCTGCTGACCCGCGACGGAGGCAACAACAACACGGAGACCTTCAGGCCAGTGGGAGGCAACATGAAGGACAACTGGCGCTCCA
AGCTGTACAAGTACAAGGTGGTGGAGGTGAAGCCCCTGGGCGTGGCACCCACCAAGGCCCGCAGGCGCATGGTGGAGCGCGAGAAGCGCG
CCGTGGGCATGGGCGCCGTGTTCCTGGGCTTCCTGGGCGCTGCGGGCTCCACCATGGGTGCCGCGTCCATCACCCTGACCGTGCAGGCCC
GCCAGCTGCTCTCCGGCATCGTGCAGCAGCAGTCCAACCTCCTGAAGGCCATCGAGGCCCAGCAGCACATGCTGAAGCTGACCGTGTGGG
GCATCAAGCAGCTGCAGGCCAGGGTGCTCGCGCTCGAGCGCTACCTGAAGGACCAGCAGCTGCTCGGCATGTGGGGCTGCTCCGGCAAGC
TGATCTGCACCACCAACGTGTACTGGAACTCGTCCTGGTCCAACAAGACCTACGGCGACATCTGGGACAACATGACCTGGATGCAGTGGG
AGCGCGAGATCTCCAACTACACCGAGATCATCTACGACCTCCTCGAGGAGTCCCAGAACCAGCAGGAGAAGAACGAGCAGGATCTGCTCG
CGCTGGACCGCTGGAACTCCCTGTGGAACTGGTTCAACATCACCAAGTGGCTGTGGTACATCAAGATCTTCATCATGATCGTGGGCGGCC
TGATCGGCCTGAAGATCATCTTCGCCGTGCTGTCGCTGGTGAACCGCGTGCGCCAGGGCTGATGAGgtgaccgggacccgaattcggatc
cagatctgctgtgcctt
>HV1300714
gtcgacaagaagccaccATGAAGGTGCGGGGCATCCAGCGCAACTACCCGCAGTGGTGGATCTGGTCGATGCTGGGCCTCTGGATGCTCA
TGATCTGCAACGGCATGGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGGAGAACG
TGACCGAGAACTTCAACATGTGGAAGAACGACATGGCGGACCAGATGCACGAGGACGTGATCTCCCTGTGGGACCAGTCCCTGAAGCCCT
GCGTGAAGCTGACCCCGCTGTGCGTGACCCTGAACTGCACGGACGCCAACGCCACCGCGTCGAACACCAACGCGACCGCAAGCAACATCA
ACGCGACGGCGTCGAAGTCCTCCATCATCGAGGAGATGAAGAACTGCTCCTTCAACATCACGACGGAGCTGCGCGACAAGCGCGAGAAGA
AGTACGCCCTGTTCTACAAGCTGGACATCGTGCAGCTGGACGGCAACTCCTCGCAGTACAGGCTGATCAACTGCAACACCTCCGTCATCA
CGCAGGCGTGCCCCAAGGTGTCCTTCGACCCCATCCCCATCCACTACTGCGCCCCGCCGGCTACGCCATCCTGAAGTGCAACAACAAGA
CCTTCAACGGCACCGGCCCGTGCAACAACGTGTCCACCGTGCAGTGCACGCACGGGATCAAGCCCGTGGTGTCCACGCAGCTGCTCCTGA
ACGGGTCGCTGGCCGAGGGCGAGATCATCATCCGGTCGGAGAACATCACGGACAACAGCAAGACCATCATCGTGCACCTGAACGAGTCCG
TGAAGATCGAGTGCACCCGCCCGAGCAACAACACGCGCACCTCCATCCGGATCGGCCCTGGCCAGGCCTTCTACGCCACCGGCCAAGTGA
TCGGCGACATCCGCGAGGCGCACTGCAACATCTCCGAGTCCAAGTGGAACGAGACCCTGCAGCGCGTGTCCAAGAAGCTGAAGGAGTACT
TCCCCGACAAGAACATCACCTTCCAGCCGTCGTCCGGCGGCGACCCCGAGATCACCACGCACTCCTTCAACTGCGGTGGCGAGTTCTTCT
ACTGCAACACGTCGTCCCTGTTCAACCGCACCTACATGGCGAACTCCACCGAGACCAACTCCACGCGCACCATCACGCTGCACTGCCGCA
TCAAGCAGATCATCAACATGTGGCAGGAGGTGGGCCGCGCCATGTACGCACCGCCCATCGCCGGCAACATCACCTGCATCTCCAACATCA
CCGGCCTCCTGCTGACCCGCGACGGCGGCGAGAACACCGGGACGGAGGCAACAACAACACGGAGACCTTCAGGCCAGAGGGAGGCAACA
TGAAGGACAACTGGCGCTCCGAGCTGTACAAGTACAAGGTGGTGGAGGTGAAGCCCCTGGGCGTGGCACCCACCAAGGCCCGCAGGCGCG
TCGTGGAGCGCGAGAAGCGCGCCGTGGGCATGGGCGCCGTGTTCCTGGGCTTCCTGGGCGCTGCGGGCTCCACCATGGGTGCCGCGTCCA
TCACCCTGACCGTGCAGGCCCGCCAGCTGCTCTCCGGCATCGTGCAGCAGCAGTCCAACCTCCTGAAGGCCATCGAGGCCCAGCAGCACA
TGCTGAAGCTGACCGTGTGGGGCATCAAGCAGCTGCAGGCCAGGGTGCTCGCGCTCGAGCGCTACCTGAAGGACCAGCAGCTGCTCGGCA
TGTGGGGCTGCTCCGGCAAGCTGATCTGCACCACCAACGTGTACTGGAACTCGTCCTGGTCCAACAAGACCTACGGCGACATCTGGGACA
ACATGACCTGGATGCAGTGGGAGCGCGAGATCTCCAACTACACCGAGATCATCTACGACCTCCTCGAGGAGTCCCAGAACCAGCAGGAGA
AGAACGAGCAGGATCTGCTCGCGCTGGACCGCTGGAACTCCCTGTGGAACTGGTTCAACATCACCAAGTGGCTGTGGTACATCAAGATCT
TCATCATGATCGTGGGCGGCCTGATCGGCCTGCGCATCATCTTCGCCGTGCTGTCGCTGGTGAACCGCGTGCGCCAGGGCTGATGAGgta
accgggacccgaattcggatccagatctgctgtgcctt
>HV1300715
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGCGGACCAGATGCACGAGGACGTGATCTCCCTGTGGGACCAGTCCCTGAAGCCCT
GCGTGAAGCTGACCCCGCTGTGCGTGACCCTGAACTGCACGGACGCCAACGCCACCGCTTCGAACATCAACGCGACGGCGTCGAAGTCCT
CCATCATCGAGGAGATGAAGAACTGCTCCTTCAACATCACGACGGAGCTGCGCGACAAGCGCGAGAAGAAGTACGCCCTGTTCTACAAGC
TGGACATCGTGCAGCTGGACGGCAACTCCTCGCAGTACAGGCTGATCAACTGCAACACCTCCGTCATCACGCAGGCGTGCCCCAAGGTGT
CCTTCGACCCCATCCCCATCCACTACTGCGCCCCCGCCGGCTACGCCATCCTGAAGTGCAACAACAAGACCTTCAACGGCACCGGCCCGT
GCAACAACGTGTCCACCGTGCAGTGCACGCACGGGATCAAGCCCGTGGTGTCCACGCAGCTGCTCCTGAACGGCTCGCTGGCCGAGGGCG
AGATCATCATCCGGTCGGAGAACATCACGGACAACAGCAAGACCATCATCGTGCACCTGAACGAGTCCGTGAAGATCGAGTGCACCCGCC
CGAGCAACAACACGCGCACCTCCATCCGGATCGGCCCTGGCCAGGCCTTCTACGCCACCGGCCAAGTGATCGGCGACATCCGCGAGGCGC
ACTGCAACATCTCCGAGTCCAAGTGGAACGAGACCCTGCAGCGCGTGTCCAAGAAGCTGAAGGAGTACTTCCCCGACAAGAACATCACCT
TCCAGCCGTCGTCCGGCGGCGACCCCGAGATCACCACGCACTCCTTCAACTGCGGTGGCGAGTTCTTCTACTGCAACACGTCGTCCCTGT
TCAACCGCACCTACATGGCGAACTCCACCGAGACCAACTCCACGCGCACCATCACGCTGCACTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCGAGAACACCCGGGACGGAGGCAACAACAACACGGAGACCTTCAGGCCAGAGGGAGGCAACATGAAGGACAACTGGCGCTCCG
AGCTGTACAAGTACAAGGTGGTGGAGGTGAAGCCCCTGGGCGTGGCACCCACCAAGGCCCGCAGGCGCGTCGTGGAGCGCGAGAAGCGCG

Fig. 21 cont.
```
CCGTGGGCATGGGCGCCGTGTTCCTGGGCTTCCTGGGCGCTGCGGGCTCCACCATGGGTGCCGCGTCCATCACCCTGACCGTGCAGGCCC
GCCAGCTGCTCTCCGGCATCGTGCAGCAGCAGTCCAACCTCCTGAAGGCCATCGAGGCCCAGCAGCACATGCTGAAGCTGACCGTGTGGG
GCATCAAGCAGCTGCAGGCCAGGGTGCTCGCGCTCGAGCGCTACCTGAAGGACCAGCAGCTGCTCGGCATGTGGGGCTGCTCCGGCAAGC
TGATCTGCACCACCAACGTGTACTGGAACTCGTCCTGGTCCAACAAGACCTACGGCGACATCTGGGACAACATGACCTGGATGCAGTGGG
AGCGCGAGATCTCCAACTACACCGACATCATCTACGAGCTCCTCGAGGAGTCCCAGAACCAGCAGGAGAAGAACGAGCAGGATCTGCTCG
CGCTGGACCGCTGGAACTCCCTGTGGAACTGGTTCAACATCACCAACTGGCTGTGGTACATCAAGATCTTCATCATGATCGTGGGCGGCC
TGATCGGCCTGCGCATCATCTTCGCCGTGCTGTCGCTGGTGAACCGCGTGCGCCAGGGCTGATGAGgttaccgggacccgaattcggatc
cagatctgctgtgccttt
>HV1300716
gtcgacaagaagccaccATGCGCGTGATGGGCATCCAGCGCAACTACCCGCAGTGGTGGATCTGGTCGATGCTGGGCCTCTGGATGCTCA
TGACCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGGAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACGGACGCCAACGCCACCGCGTCGAACACGAACGCGACCGCAAGCAACATCA
ACGCGACGGCGTCGAAGTCCTCCATCATCGAGGAGATGAAGAACTGCTCCTTCAACATCACGACGGAGCTGCGCGACAAGCGCGAGAAGA
AGTACGCCCTGTTCTACAAGCTGGACATCGTGCAGCTGGACGGCAACTCCTCGCAGTACAGGCTGATCAACTGCAACACCTCCGTCATCA
CGCAGGCGTGCCCCAAGGTGTCCTTCGACCCCATCCCCATCCACTACTGCGCCCCCGCCGGCTACGCCATCCTGAAGTGCAACAACAAGA
CCTTCAACGGCACCGGCCCGTGCAACAACGTGTCCACCGTGCAGTGCACGCACGGGATCAAGCCCGTGGTGTCCACGCAGCTGCTCCTGA
ACGGGTCGCTGGCCGAGGGCGAGATCATCATCCGGTCGAAGAACATCACGGACAACGGGAAGACCATCATCGTGCACCTGAACGAGTCCG
TGAAGATCGAGTGCACCCGCCCGAGCAACAACACGCGCACCTCCATCCGGATCGGCCCTGGCCAGGCCTTCTACGCCACCGGCCAAGTGA
TCGGCGACATCCGCGAGGCGCACTGCAACATCTCCGAGTCCAAGTGGAACGAGACCCTGCAGCGCGTGTCCAAGAAGCTGAAGGAGTACT
TCCCCGACAAGAACATCACCTTCCAGTCCTCGTCCGGCGGCGACCCCGAGATCACCACGCACTCCTTCAACTGCGGTGGCGAGTTCTTCT
ACTGCAACACGTCGTCCCTGTTCAACCGCACCTACATGGCGAACTCGACGGACATGGCCAACTCCACCGAGACCAACTCCACGCGCATCA
TCACGATCCACTGCCGCATCAAGCAGATCATCAACATGTGGCAGGAGGTGGGCCGCGCCATGTACGCACCGCCCATCGCCGGCAACATCA
CCTGCATCTCCAACATCACCGGCCTCCTGCTGACCCGCGGCGGCGGCGAACAACGGAGGCAAGAACAACACGGAGACCTTCAGGCCAG
GGGGAGGCAACATGAAGGACAACTGGCGCTCGAGCTGTACAAGTACAAGGTGGTGGAGGTGAAGCCCCTGGGCGTGGCACCCACCAAGG
CCCGCAGGCGCGTCGTGGAGCGCGAGAAGCGCGCCGTGGGCATGGGCGCCGTGTTCCTGGGCTTCCTGGGCGCTGCGGGCTCCACCATGG
GTGCCGCGTCCATCACCCTGACCGTGCAGGCCCGCCAGCTGCTCTCCGGCATCGTGCAGCAGCAGTCCAACCTCCTGAAGGCCATCGAGG
CCCAGCAGCACATGCTGAAGCTGACCGTGTGGGGCATCAAGCAGCTGCAGGCCAGGGTGCTCGCGCTCGAGCGCTACCTGAAGGACCAGC
AGCTGCTCGGCATGTGGGGCTGCTCCGGCAAGCTGATCTGCACCACCAACGTGTACTGGAACTCGTCCTGGTCCAACAAGACCTACGGCG
ACATCTGGGACAACATGACCTGGATGCAGTGGGAGCGCGAGATCTCCAACTACACCGACATCATCTACGACCTCCTCGAGGAGTCCCAGA
ACCAGCAGGAGAAGAACGAGCAGGATCTGCTCGCGCTGGACCGCTGGAACTCCCTGTGGAACTGGTTCAACATCACCAAGTGGCTGTGGT
ACATCAAGATCTTCATCATGATCGTGGGCGGCCTGATCGGCCTGCGCATCATCTTCGCCGTGCTGTCGCTGGTGAACCGCGTGCGCCAGG
GCTGATGAGgtgaccgggtcccgaattcggatccagatctgctgtgccttt
>HV1300717
gtcgacaagaagccaccATGCGCGTGCGCGGCATCCAGCGCAACTACCCGCAGTGGTGGATCTGGTCGATGCTGGGCCTCTGGATGCTCA
TGACCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGCGCACAACGTGTGGGCGACCCACGCCTGCGTGCCCACGGACCCCAACCCGCAGGAGATGGTGCTGAAGAACG
TGACCGAGAACTTCAACATGTGGGAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACGGACGCCAACGCCACCGCGTCGAACACGAACGCGACCGTCAGCAACATCA
AGGCGACGGTGTCGAACTCCTCCATCATCGAGGAGATGAAGAACTGCTCCTTCAACATCACGACGGAGCTGCGCGACAAGATCGAGAAGA
AGTACGCCCTGTTCTACAAGCTGGACATCGTGCAGCTGGACGGCAACTCCACGCAGTACCGCTTCATCAACTGCAACACCTCCGCGATCA
CGCAGGCGTGCCCCAAGGTGTCCTTCGACCCCATCCCCATCCACTACTGCGCCCCCGCCGGCTACGCCATCCTGAAGTGCAACAACAAGA
CCTTCAACGGCACCGGCCCGTGCAACAACGTGTCCACCGTGCAGTGCACGCACGGGATCAAGCCCGTGGTGTCCACGCAGCTGCTCCTGA
ACGGGTCGCTGGCCGAGGGCGAGATCATCATCCGGTCGGAGAACATCACGGACAACGGGAAGACCATCATCGTGCACCTGAACGAGTCCG
TGAAGATCGAGTGCACCCGCCCGGGAACAACACGCGCACCTCCATCCGGATCGGCCCTGGCCAGGCCTTCTACGCCACCGGCCAAGTGA
TCGGCGATACCGCGAGGCGCACTGCAACATCTCCGAGTCCAAGTGGAACGAGACCCTGCAGCGCGTGTCCGAGAAGCTGAAGGAGTACT
TCCCCAACAAGACGATCACCTTCCAGCCGTCGTCCGGCGGCGACCCCGAGATCACCACGCACTCCTTCAACTGCGGTGGCGAGTTCTTCT
ACTGCAACACGTCGTCCCTGTTCAACCGCACCTACATGGCGAACTCCACCGAGACCAACTCCACGCGCACCATCACGCTCCACTGCCGCA
TCAAGCAGATCATCAACATGTGGCAGGAGGTGGGCCGCGCCATGTACGCACCGCCCATCGCCGGCAACATCACCTGCATCTCCAACATCA
CCGGCCTCCTGCTGACCCGCGACGGCGGCAACACGACCGACATCGAGACCTTCAGGCCAGGGGGAGGCAACATGAAGGACAACTGGCGCT
CCGAGCTGTACAAGTACAAGGTGGTGGAGGTGAAGCCCCTGGGCGTGGCACCCACCAAGGCCCGCAGGCGCGTCGTGGAGCGCGAGAAGC
GCGCCGTGGGCATGGGCGCCGTGTTCCTGGGCTTCCTGGGCGCTGCGGGCTCCACCATGGGTGCCGCGTCCATCACCCTGACCGTGCAGG
CCCGCCAGCTGCTCTCCGGCATCGTGCAGCAGCAGTCCAACCTCCTGAAGGCCATCGAGGCCCAGCAGCACATGCTGAAGCTGACCGTGT
GGGGCATCAAGCAGCTGCAGGCCAGGGTGCTCGCGCTCGAGCGCTACCTGAAGGACCAGCAGCTGCTCGGCATGTGGGGCTGCTCCGGCA
AGCTGATCTGCACCACCAACGTGTACTGGAACTCGTCCTGGTCCAACAAGACCTACGACGACATCTGGGACAACATGACCTGGATGCAGT
GGGAGCGCGAGATCTCCAACTACACCGAGATCATCTACGACCTCCTCGAGGAGTCCCAGAACCAGCAGGAGAAGAACGAGCAGGATCTGC
```

Fig. 21 cont.
```
TCGCGCTGGACCGCTGGAACTCCCTGTGGAACTGGTTCAACATCACCAAGTGGCTGTGGTACATCAAGATCTTCATCATGATCGTGGGCG
GCCTGATCGGCCTGCGCATCATCTTCGCCGTGCTGTCGCTGGTGAACCGCGTGCGCCAGGGCTGATGAGgtgaccaggacccgaattcgg
atccagatctgctgtgcctt
>HV1300718
gtcgacaagaagccaccATGCGCGTGCGCGGCATCCAGCGCAACTACCCGCAGTGGTGGATCTGGTCGATGCTGGGCCTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGCGCACAACGTGTGGGCGACCCACGCCTGCGTGCCCACGGACCCCAACCCGCAGGAGATGGTGCTGAAGAACG
TGACCGAGAACTTCAACATGTGGGAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACGGACGCCAACGCCACCGCGTCGAACGCCAACGCGACCGCCAGCAACACGA
ACGCGACGGTGTCGAACGACTCCTCCATCATCGAGGAGATGAAGAACTGCTCCTTCAACATCACGACGGAGCTGCGCGACAAGATCGAGA
AGAAGTACGCCCTGTTCTACAAGCTGGACATCGTGCAGCTGGACGGCAACTCCACGCAGTACCGCTTCATCAACTGCAACACCTCCGCGA
TCACGCAGGCGTGCCCCAAGGTGTCCTTCGACCCCATCCCCATCCACTACTGCGCCCCCGCCGGCTACGCCATCCTGAAGTGCAACAACA
AGACCTTCAACGGCACCGGCCCGTGCAACAACGTGTCCACCGTGCAGTGCACGCACGGGATCAAGCCCGTGGTGTCCACGCAGCTGCTCC
TGAACGGGTCGCTGGCCGAGGGCGAGATCATCATCCGGTCGAAGAACATCACGGACAACGGGAACACCATCATCGTGCACCTGAACGAGT
CCGTGAAGATCGAGTGCACCCGCCCGTCCAACAACACGCGCACCTCCATCCGGATCGGCCCTGGCCAGGCCTTCTACGCCACCGGCCAAG
TGATCGGCGACATCCGCCAGGCGCACTGCAACATCTCCGAGTCCAAGTGGAACGAGACCCTGCAGCGCGTGTCCGAGAAGCTGAAGGAGT
ACTTCCCCGACAAGAACATCACCTTCCAGCCGTCGTCCGGCGGCGACCCCGAGATCACCACGCACTCCTTCAACTGCGGTGGCGAGTTCT
TCTACTGCAACACGTCGTCCCTGTTCAACCGCACCTACATGGCGAACTCCACCGAGACCAACTCCACGCGCACCATCACGCTCCACTGCC
GCATCAAGCAGATCATCAACATGTGGCAGGAGGTGGGCCGCGCCATGTACGCACCGCCCATCGCCGGCAACATCACCTGCATCTCCAACA
TCACCGGCCTCCTGCTGACCCGCGACGGCGGCAACTCGTCCAAGGAGACCGAGACCTTCAGGCCAGGGGAGGCAACATGAAGGACAACT
GGCGCTCCGAGCTGTACAAGTACAAGGTGGTGGAGGTGAAGCCCCTGGGCGTGGCACCCACCAACGCCCGCAGGCGCGTCGTGGAGCGCG
AGAAGCGCGCCGTGGGCATGGGCGCCGTGTTCCTGGGCTTCCTGGGCGCTGCGGGCTCCACCATGGGTGCCGCGTCCATCACCCTGACCG
TGCAGGCCCGCCAGCTGCTCTCCGGCATCGTGCAGCAGCAGTCCAACCTCCTGAAGGCCATCGAGGCCCAGCAGCACATGCTGCGGCTGA
CCGTGTGGGGCATCAAGCAGCTGCAGGCCAGGGTGCTCGCGCTCGAGCGCTACCTGAAGGACCAGCAGCTGCTCGGCATGTGGGGCTGCT
CCGGCAAGCTGATCTGCACCACCAACGTGTACTGGAACTCGTCCTGGTCCAACAAGACCTACTCGGACATCTGGGACAACATGACCTGGA
TGCAGTGGGAGGGGGAGATCTCCAACTACACCGAGATCATCTACAACCTCCTCGAGGAGTCCCAGAACCAGCAGGAGAAGAACGAGCAGG
ATCTGCTCGCGCTGGACCGCTGGAACTCCCTGTGGAACTGGTTCAACATCACCAAGTGGCTGTGGTACATCAAGATCTTCATCATGATCG
TGGGCGGCCTGATCGGCCTGCGCATCATCTTCGCCGTGCTGTCGCTGGTGAACCGCGTGCGCCAGGGCTGATGAGgtgaccaggtcccga
attcggatccagatctgctgtgcctt
>HV1300719
gtcgacaagaagccaccATGCGCGTGCGCGGCATCCAGCGCAGCTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCAACGCCACCAACGCGACGGACTCGAACTCCAACATCCTCGAGGGGATGA
AGAACTGCTCCTTCAACATCACGACGGAGCTGCGCGACAAGCGCGAGAAGAAGAACGCCCTGTTCTACAAGCTGGACATCGTGCAGCTGG
GCGGCAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCCGCCGGCTACGCCATCCTGAAGTGCAACAAGGCGTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACAGCAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCAACATCCGCGAGGCGCACTGCAACATCTCCGAGT
CCAAGTGGAACGAGACCCTGCAGCGCGTGTCCGAGAAGCTGAAGGAGTACTTCCCCGACAAGAACATCACCTTCCGGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
CGACCTCCACGGACATGGCCAACTCCACCGAGACGAACTCCACGCGCATCATCACGATCCACTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAACAACACGGAGGACACGGAGACCTTCAGGCCAGAGGGAGGCAACATGAAGGACAACTGGCGCTCCGAGCTGTACAAGTACA
AGGTGGTGGAGGTGAAGCCCCTGGGCGTGGCACCCACCAACGCCCGCAGGCGCGTCGTGGAGCGCGAGAAGCGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
ACGTGTACTGGAACTCGTCCTGGTCCAACAAGACCTACTCGGACATCTGGGACAACATGACCTGGATGCAGTGGGAACAATGACCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACCGGGTGCGCCAGGGCTGATGAGgtgaccgggacctgaattcggatccagatctgctgtgcc
tt
>HV1300720
```

Fig. 21 cont.
gtcgacaagaagccaccATGCGCGTGATGGGCACCCAGCGCAACTACCCGCAGTGGTGGATCTGGTCGATGCTGGGCCTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGCGGACCAGATGCACGAGGACGTGATCTCCCTGTGGGACCAGTCCCTGAAGCCCT
GCGTGAAGCTGACCCCGCTGTGCGTGACCCTGTACTGCATCAACGCCACCGCCAACGCGACGGTCTCGAACTCCTCGATCATCGAGGAGA
TGAAGAACTGCTCCTTCAACATCACGACGGAGCTGCGCGACAAGCGCGAGAAGAAGAACGCCCTGTTCTACAAGCTGGACATCGTGCAGC
TGGACGGCAACTCCTCGCAGTACAGGCTGATCAACTGCAACACCTCCGCGATCACGCAGGCGTGCCCCAAGGTGTCCTTCGACCCCATCC
CCATCCACTACTGCGCCCCGCCGGCTACGCCATCCTGAAGTGCAACAACAAGACCTTCAACGGCACCGGCCCGTGCAACAACGTGTCCA
CCGTGCAGTGCACGCACGGGATCAAGCCCGTGGTGTCCACGCAGCTGCTCCTGAACGGGTCGCTGGCCGAGGGCGAGATCATCATCCGGT
CGGAGAACATCACGAACAGCGCGAAGACCATCATCGTGCACCTGAACGAGTCCGTGAAGATCGAGTGCACCCGCCCGAGCAACAACACGC
GCACCTCCATCCGGATCGGCCCTGGCCAGGCCTTCTACGCCACCGGCCAGGTGATCGGCGACATCCGCCAGGCGCACTGCAACATCTCCG
AGTCCAAGTGGAACGAGACCCTGCAGCGCGTGTCCGAGAAGCTGAAGGAGTACTTCCCCAACAAGACGATCACCTTCCAGCCGTCGTCCG
GCGGCGACCCCGAGATCACCACGCACTCCTTCAACTGCGGTGGCGAGTTCTTCTACTGCAACACGTCGTCCCTGTTCAACCGCACCTACA
TGGCGAACTCCACCGACATGGCCAACTCCACCGAGACGAACTCCACGCGCACCATCACGCTCCACTGCCGCATCAAGCAGATCATCAACA
TGTGGCAGGAGGTGGGCCGCGCCATGTACGCACCGCCCATCGCCGGCAACATCACCTGCATCTCCAACATCACCGGCCTCCTGCTGACCC
GCGACGGCGGCAACAGCTCCAAGGAGACGGAGACCTTCAGGCCAGGGGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTCGTGGAGCGCGAGAAGCGCGCCGTGGGCATGG
GCGCCGTGTTCCTGGGCTTCCTGGGCGCTGCGGGCTCCACCATGGGTGCCGCGTCCATCACCCTGACCGTGCAGGCCCGCCAGCTGCTCT
CCGGCATCGTGCAGCAGCAGTCCAACCTCCTGAAGGCCATCGAGGCCCAGCAGCACATGCTGAAGCTGACCGTGTGGGGCATCAAGCAGC
TGCAGGCCAGGGTGCTCGCGCTCGAGCGCTACCTGAAGGACCAGCAGCTGCTCGGCATGTGGGGCTGCTCCGGCAAGCTGATCTGCACCA
CCAACGTGTACTGGAACTCGTCCTGGTCCAACAAGACCTACGGGGACATCTGGGACAACATGACCTGGATGCAGTGGGAGCGCGAGATCT
CCAACTACACCGACCTCATCTACGACCTCCTCGAGGAGTCCCAGAACCAGCAGGAGAAGAACGAGCAGGATCTGCTCGCGCTGGACCGCT
GGAACTCCCTGTGGAACTGGTTCAACATCACCAAGTGGCTGTGGTACATCAAGATCTTCATCATGATCGTGGGCGGCCTGATCGGCCTGC
GCATCATCTTCGCCGTGCTGTCGCTGGTGAACCGCGTGCGCCAGGGCTGATGAGgtgaccgggtcctgaattcggatccagatctgctgt
gcctt
>HV1300721
gtcgacaagaagccaccATGCGCGTGCGCGGCATCCAGCGCAGCTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGGAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCAACGCCACCAACGCGACGGACTCGAACTCCAACATCCTCGAGGGGATGA
AGAACTGCTCCTTCAACATCACGACGGAGCTGCGCGACAAGCGCGAGAAGAAGAACGCCCTGTTCTACAAGCTGGACATCGTGCAGCTGG
GCGGCAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACAGCAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCAACATCCGCGAGGCGCACTGCAACATCTCCGAGT
CCAAGTGGAACGAGACCCTGCAGCGCGTGTCCGAGAAGCTGAAGAAGTACTTCCCCGACAAGAACATCACCTTCCGGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
CGACGTCCACCGACATGGCCAACTCCACCGAGACGAACTCCACGCGCATCATCACGATCCACTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAACAACACGGAGGACACGGAGACCTTCAGGCCAGAGGGGAGGCAACATGAAGGACAACTGGCGCTCCGAGCTGTACAAGTACA
AGGTGGTGGAGGTGAAGCCCCTGGGCGTGGCACCCACCAACGCCCGCAGGCGCGTCGTGGAGCGCGAGAAGCGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
ACGTGTACTGGAACTCGTCCTGGTCCAACAAGACCTACGACGACATCTGGGACAACATGACCTGGATGCAGTGGGAGCGCGAGATCTCCA
ACTACACCAACATCATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACCGCGTGCGCCAGGGCTGATGAGgtcaccgggtcccgaattcggatccagatctgctgtgcc
tt
>HV1300722
gtcgacaagaagccaccATGCGCGTGATGGGCATCCAGCGCAGCTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAGCTGCATCAACGCCACCAACGCGACGGACTCGAACAACTCCATCCTCGAGGGGATGA

Fig. 21 cont.

AGAACTGCTCCTTCAACATCACGACGGAGCTGCGCGACAAGCGCGAGAAGAAGAACGCCCTGTTCTACAAGCTGGACATCGTGCAGCTGT
ACGGCAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACGGGAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCAACATCCGCGAGGCGCACTGCAACATCTCCGAGT
CCAAGTGGAACGAGACCCTGCAGCGCGTGTCCGAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
CGACGTCCACCGACATGGCCAACTCCACCGAGACCAACTCCACGCGCATCATCACGATCCACTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAACAACACGGAGGACACGGAGACCTTCAGGCCAGAGGGAGGCAACATGAAGGACAACTGGCGCTCCGAGCTGTACAAGTACA
AGGTGGTGGAGGTGAAGCCCCTGGGCGTGGCACCCACCAACGCCCGCAGGCGCGTCGTGGAGCGCGAGAAGCGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
ACGTGTACTGGAACTCGTCCTGGTCCAACAAGACCTACAGCGACATCTGGGACAACATGACCTGGATGCAGTGGGAGCGCGAGATCTCCA
ACTACACCGACATGATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACCGCGTGCGCCAGGGCTGATGAGgtcaccaggacccgaattcggatccagatctgctgtgcc
tt
>HV1300723
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCAACGCCACCAACGCGACGGACTCGAACTCCAACATCCTCGAGGGGATGA
AGAACTGCTCCTTCAACATCACGACGGAGCTGCGCGACAAGCGCGAGAAGAAGAACGCCCTGTTCTACAAGCTGGACATCGTGCAGCTGG
GCGGCAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACAGCAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCAACATCCGCGAGGCGCACTGCAACATCTCCGAGT
CCAAGTGGAACGAGACCCTGCAGCGCGTGTCCGAGAAGCTGAAGAAGTACTTCCCCGACAAGAACATCACCTTCCGGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
CGACGTCCACCGACATGGCCAACTCCACCGAGATCAACTCCACGCGCATCATCACGATCCACTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAACAACACGGAGGACACGGAGACCTTCAGGCCAGAGGGAGGCAACATGAAGGACAACTGGCGCTCCGAGCTGTACAAGTACA
AGGTGGTGGAGGTGAAGCCCCTGGGCGTGGCACCCACCAACGCCCGCAGGCGCGTCGTGGAGCGCGAGAAGCGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
ACGTGTACTGGAACTCGTCCTGGTCCAACAAGACCTACGACGACATCTGGGACAACATGACCTGGATGCAGTGGGAGCGCGAGATCTCCA
ACTACACCAACATCATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACCGCGTGCGCCAGGGCTGATGAGgtcaccaggtcccgaattcggatccagatctgctgtgcc
tt
>HV1300724
gtcgacaagaagccaccATGCGCGTGATGGGCCGGCAGCGCAACTACCCGCAGTGGTGGATCTGGTCGATGCTGGGCCTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGACGCCCT
GCGTGAAGCTGACCCCGCTGTGCGTGACCCTGAACTGCACGGACGCCAACGACACCGCGTCGAACAGCTCCATCATCAAGGGGATGAACA
ACTCCATCGTGGGGGAGATGAAGAACTGCTCCTTCAACATCACGACGGAGCTGCGCGACAAGCGCGAGAAGAAGAACGCCCTGTTCTACA
AGCTGGACATCGTGCAGCTGGACGGCAACTCCTCGGAGTACAGGCTGATCAACTGCAACACCTCCGTCATCACGCAGGCGTGCCCCAAGG
TGTCCTTCGACCCCATCCCCATCCACTACTGCGCCCCCGCCGGCTACGCCATCCTGAAGTGCAACAACAAGACCTTCAACGGCACCGGCC
CGTGCAACAACGTGTCCACCGTGCAGTGCACGCACGGGATCAAGCCCGTGGTGTCCACGCAGCTGCTCCTGAACGGGTCGCTGGCCGAGG
GCGAGATCATCATCCGGTCGGAGAACATCACGGACAACGCGAAGACCATCATCGTGCACCTGAACGAGTCCGTGAAGATCGAGTGCACCC

Fig. 21 cont.
```
GCCCGAGCAACAACACGCGCACCTCCATCCGGATCGGCCCTGGCCAGGCCTTCTACGCCACCGGCCAGGTGATCGGCGACATCCGCAAGG
CGCACTGCAACATCTCCGAGTCCAAGTGGAACGAGACCCTGCAGCGCGTGTCCAAGAAGCTGAAGGAGTACTTCCCCGACAAGAACATCA
CCTTCCAGCCGTCGTCCGGCGGCGACCCCGAGATCACCACGCACTCCTTCAACTGCGGTGGCGAGTTCTTCTACTGCAACACGTCGTCCC
TGTTCAACCGCACCTACATGGCCAACTCGACGGACATGGCGAACTCCGCGGAGACCAACTCCACGCGCACCATCACGCTCCACTGCCGCA
TCAAGCAGATCATCAACATGTGGCAGGAGGTGGGCCGCGCCATGTACGCACCGCCCATCGCCGGCAACATCACCTGCATCTCCAACATCA
CCGGCCTCCTGCTGACCCGCGACGGAGGCAACTCCAGCACGGAGACGGAGACCTTCAGGCCAGGGGGAGGCAACATGAAGGACAACTGGC
GCTCCGAGCTGTACAAGTACAAGGTGGTGGAGGTGAAGCCCCTGGGCGTGGCACCCACCAACGCCCGCAGGCGCGTGGTGGAGCGCGAGA
AGCGCGCCGTGGGCATGGGCGCCGTGTTCCTGGGCTTCCTGGGCGCTGCGGGCTCCACCATGGGTGCCGCGTCCATCACCCTGACCGTGC
AGGCCCGCCAGCTGCTCTCCGGCATCGTGCAGCAGCAGTCCAACCTCCTGAAGGCCATCGAGGCCCAGCAGCACATGCTGCGGCTGACCG
TGTGGGGCATCAAGCAGCTGCAGGCCAGGGTGCTCGCGCTCGAGCGCTACCTGAAGGACCAGCAGCTGCTCGGCATGTGGGGCTGCTCCG
GCAAGCTGATCTGCACCACCAACGTGTACTGGAACTCGTCCTGGTCCAACAAGACCTACGACGACATCTGGGACAACATGACCTGGATGC
AGTGGGAGGGGGAGATCTCCAACTACACCAACATCATCTACGACCTCCTCGAGGAGTCCCAGAACCAGCAGGAGAAGAACGAGCAGGATC
TGCTCGCGCTGGACCGCTGGAACTCCCTGTGGAACTGGTTCAACATCACCAACTGGCTGTGGTACATCAAGATCTTCATCATGATCGTGG
GCGGCCTGATCGGCCTGCGGATCATCTTCGCCGTGCTGTCGCTGGTGAACCGCGTGCGCCAGGGCTGATGAGgtcaccgggacctgaatt
cggatccagatctgctgtgccctt
>HV1300725
gtcgacaagaagccaccATGCGCGTGCGCGGCATCCAGCGCAGCTACCCGCAGTGGTGGATCTGGTCGATGCTGGGCTTCTGGATGCTCA
TGATCTGCAACGGCATGTGGGTGACGGTGTACTACGGCGTGCCGGTGTGGCGGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGGAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCAACGCCACCAACGCGACGGACTCGAACTCCAACATCCTCGAGGGGATGA
AGAACTGCTCCTTCAACATCACGACGGAGCTGCGCGACAAGCGCGAGAAGAAGAACGCCCTGTTCTACAAGCTGGACATCGTGCAGCTGG
GCGGCAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACAGCAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCAACATCCGCGAGGCGCACTGCAACATCTCCGAGT
CCAAGTGGAACGAGACCCTGCAGCGCGTGTCCAAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
CGAACTCGACATGGCCAACTCCACCGAGGACGAACTCCACGCGCATCATCACGATCCACTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAACAACACGGAGGACACGGAGACCTTCAGGCCAGAGGGAGGCAACATGAAGGACAACTGGCGCTCCGAGCTGTACAAGTACA
AGGTGGTGGAGGTGAAGCCCCTGGGCGTGGCACCCACCAACGCCCGCAGGCGCGTCGTGGAGCGCGAGAAGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
ACGTGTACTGGAACTCGTCCTGGTCCAACAAGACCTACGACGACATCTGGGACAACATGACCTGGATGCAGTGGGAGCGCGAGATCTCCA
ACTACACCAACATCATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACAAAGTGCGCCAGGGCTGATGAGgtcaccgggtcctgaattcggatccagatctgctgtgcc
tt
>HV1300726
gtcgacaagaagccaccATGCGCGTGCGCGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCAACGCCACCAACGCGACGGCGTCGAACTCCAACATCCTCGAGGGGATGA
AGAACTGCTCCTTCAACATCACGACGGAGCTGCGCGACAAGCGCGAGAAGAAGAACGCCCTGTTCTACAAGCTGGACATCGTGCAGCTGG
GCGGCAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACAGCAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCAACATCCGCGAGGCGCACTGCAACATCTCCGAGT
CCAAGTGGAACGAGACCCTGCAGCGCGTGTCCGAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
CGAACTCCACGGACATGGCCAACTCCACCGAGACGAACTCCACGCGCATCATCACGCTCCACTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
```

Fig. 21 cont.
ACGGCGGCAACAACACGGAGGACACGGAGACCTTCAGGCCAGAGGGAGGCAACATGAAGGACAACTGGCGCTCCGAGCTGTACAAGTACA
AGGTGGTGGAGGTGAAGCCCCTGGGCGTGGCACCCACCAACGCCCGCAGGCGCGTCGTGGAGCGCGAGAAGCGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
ACGTGTACTGGAACTCGTCCTGGTCCAACAAGACCTACAGCGACATCTGGGACAACATGACCTGGATGCAGTGGGAGCGCGAGATCTCCA
ACTACACCGACATGATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACCGGGTGCGCCAGGGCTGATGAGgtaaccgggtcccgaattcggatccagatctgctgtgcc
tt
>HV1300727
gtcgacaagaagccaccATGCGCGTGCGCGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCAACGCCACCAACGCGACGGACTCGAACTCCAACATCCTCGAGGGGATGA
AGAACTGCTCCTTCAACATCACGACGGAGCTGCGCGACAAGCGCGAGAAGAAGAACGCCCTGTTCTACAAGCTGGACATCGTGCAGCTGG
GCGGCAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACAGCAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCAACATCCGCGAGGCGCACTGCAACATCTCCGAGT
CCAAGTGGAACGAGACCCTGCAGCGCGTGTCCGAGAAGCTGAAGGAAGTACTTCCCCGACAAGAACATCACCTTCCGGCCGTCGTCCGGCG
GCGACCTCGAGATCACCACGCACTCCTTCAACTGCGGTGGCGAGTTCTTCTACTGCAACACGTCGTCCCTGTTCAACGCACCTACATGG
CGACCTCCACGGACATGGCCAACTCCACCGAGACGAACTCCACGCGCATCATCACGATCCACTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAACAACACGGAGGACACGGAGACCTTCAGGCCAGAGGGAGGCAACATGAAGGACAACTGGCGCTCCGAGCTGTACAAGTACA
AGGTGGTGGAGGTGAAGCCCCTGGGCGTGGCACCCACCAACGCCCGCAGGCGCGTCGTGGAGCGCGAGAAGCGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
ACGTGTACTGGAACTCGTCCTGGTCCAACAAGACCTACAGCGACATCTGGGACAACATGACCTGGATGCAGTGGGAGCGCGAGATCTCCA
ACTACACCAACATCATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACCGGGTGCGCCAGGGCTGATGAGgtaaccaggacccgaattcggatccagatctgctgtgcc
tt
>HV1300728
gtcgacaagaagccaccATGCGCGTGCGCGGCATCCAGCGCAGCTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGGAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCAACGCCACCAACGCGACGGACTCGAACTCCAACATCCTCGAGGGGATGA
AGAACTGCTCCTTCAACATCACGACGGAGCTGCGCGACAAGCGCGAGAAGAAGAACGCCCTGTTCTACAAGCTGGACATCGTGCAGCTGG
GCGGCAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCGCCGGCTACGCCATCCTGAAGTGCAACAACAAGGCGTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACAGCAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCAACATCCGCGAGGCGCACTGCAACATCTCCGAGT
CCAAGTGGAACGAGACCCTGCAGCGCGTGTCCGAGAAGCTGAAGGAAGTACTTCCCCGACAAGAACATCACCTTCCGGCCGTCGTCCGGCG
GCGACCTCGAGATCACCACGCACTCCTTCAACTGCGGTGGCGAGTTCTTCTACTGCAACACGTCGTCCCTGTTCAACGCACCTACATGG
CGACCTCCACGGACATGGCCAACTCCACCGAGACGAACTCCACGCGCATCATCACGATCCACTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAACAACACGGAGGACACGGAGACCTTCAGGCCAGAGGGAGGCAACATGAAGGACAACTGGCGCTCCGAGCTGTACAAGTACA
AGGTGGTGGAGGTGAAGCCCCTGGGCGTGGCACCCACCAACGCCCGCAGGCGCGTCGTGGAGCGCGAGAAGCGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA

Fig. 21 cont.

ACGTGTACTGGAACTCGTCCTGGTCCAACAAGACCTACGACGACATCTGGGACAACATGACCTGGATGCAGTGGGAGCGCGAGATCTCCA
ACTACACCAACATCATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACCGGGTGCGCCAGGGCTGATGAGgtaaccaggtcccgaattcggatccagatctgctgtgcc
tt
>HV1300729
gtcgacaagaagccaccATGCGCGTGCGCGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGGAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCAACGCCACCAACGCGACGGACTCGAAGTCCAACATCCTCGAGGGGATGA
AGAACTGCTCCTTCAACATCACGACGGAGCTGCGCGACAAGCGCGAGAAGAAGAACGCCCTGTTCTACAAGCTGGACATCGTGCAGCTGG
GCGGGAACTCCAACAGCTCGCAGTACAGGCTGATCAACTGCAACACCTCCGTCATCACGCAGGCGTGCCCCAAGGTGTCCTTCGACCCCA
TCCCCATCCACTACTGCGCCCCGCCGGCTACGCCATCCTGAAGTGCAACAACAAGACCTTCAACGGCACCGGCCCGTGCAACAACGTGT
CCACCGTGCAGTGCACGCACGGGATCAAGCCCGTGGTGTCCACGCAGCTGCTCCTGAACGGGTCGCTGGCCGAGGGCGAGATCATCATCC
GGTCCAAGAACATCACGGACAACAGCAAGACCATCATCGTGCACCTGAACGAGTCCGTGAAGATCGAGTGCACCCGCCCGAGCAACAACA
CGCGCACCTCCATCCGGATCGGCCCTGGCCAGGCCTTCTACGCCACCGGCCAGGTGATCGGCAACATCCGCGAGGCGCACTGCAACATCT
CCGAGTCCAAGTGGAACGAGACCCTGCAGCGCGTGTCCGAGAAGCTGAAGGAGTACTTCCCCCAGAAGAACATCACCTTCCAGCCGTCGT
CCGGCGGCGACCTCGAGATCACCACGCACTCCTTCAACTGCGGTGGCGAGTTCTTCTACTGCAACACGTCGTCCCTGTTCAACCGCACCT
ACATGGCGACGGCCACCGACATGGCCAACTCCACCGAGACGAACATCATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCTGACCCGCGACG
GCGGCAACTCCACGGAGGACACGGAGACCTTCAGGCCAGTGGGAGGCAACATGAAGGACAACTGGTCGTCCGAGCTGTACAAGTACAAGG
TGGTGGAGGTGAAGCCCCTGGGCGTGGCACCCACCAACGCCCGCAGGCGCGTCGTGGAGCGCGAGAAGCGCGCCGTGGGCATGGGCGCCG
TGTTCCTGGGCTTCCTGGGCGCTGCGGGCTCCACCATGGGTGCCGCGTCCATCACCCTGACCGTGCAGGCCCGCCAGCTGCTCTCCGGCA
TCGTGCAGCAGCAGTCCAACCTCCTGAAGGCCATCGAGGCCCAGCAGCACATGCTGAAGCTGACCGTGTGGGGCATCAAGCAGCTGCAGG
CCAGGGTGCTCGCGCTCGAGCGCTACCTGAAGGACCAGCAGCTGCTCGGCATGTGGGGCTGCTCCGGCAAGCTGATCTGCACCACCAACG
TGTACTGGAACTCGTCCTGGTCCAACAAGACCTACGACGACATCTGGGACAACATGACCTGGATGCAGTGGGAGCGCGAGATCTCCAACT
ACACCAACATCATCTACGAGCTCCTCGAGGAGTCCCAGAACCAGCAGGAGAAGAACGAGCAGGATCTGCTCGCGCTGGACCGCTGGAACT
CCCTGTGGAACTGGTTCAACATCACCAACTGGCTGTGGTACATCAAGATCTTCATCATGATCGTGGGCGGCCTGATCGGCCTGCGCATCA
TCTTCGCCGTGCTGTCGCTGGTGAACCGCGTGCGCCAGGGCTGATGAGgtaaccgggacctgaattcggatccagatctgctgtgccttt
>HV1300730
gtcgacaagaagccaccATGCGCGTGCGCGGCATCCAGCGCAGCTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGGAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCAACGCCACCAACGCGACGGCCTCGGACTCCTCGATCCTCGACGGGATGA
AGAACTGCTCCTTCAACATCACGACGGAGCTGCGCGACAAGCGCGAGAAGAAGAACGCCCTGTTCTACAAGCTGGACATCGTGCAGCTGG
GCTCCAACAGCTCGCAGTACAGGCTGATCAACTGCAACACCTCCGTCATCACGCAGGCGTGCCCCAAGGTGTCCTTCGACCCCATCCCCA
TCCACTACTGCGCCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACAGCAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCAACATCCGCGAGGCGCACTGCAACATCTCCGAGT
CCAAGTGGAACGAGACCCTGCAGCGCGTGTCCGAGAAGCTGAAGGAGTACTTCCCCGACAAGAAGATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
CGAACAGCACCGACATGGCCAACTCCACCGAGACGAACTCGACGCAGATCATCACGATCCACTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAACAACACGGAGGACACGGAGACCTTCAGGCCAGTGGGAGGCAACATGAAGGACAACTGGTCGTCCGAGCTGTACAAGTACA
AGGTGGTGGAGGTGAAGCCCCTGGGCGTGGCACCCACCAACGCCCGCAGGCGCGTCGTGGAGCGCGAGAAGCGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
ACGTGTACTGGAACTCGTCCTGGTCCAACAAGACCTACGACGACATCTGGGACAACATGACCTGGATGCAGTGGGAGCGCGAGATCTCCA
ACTACACCGAGATCATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACCGCGTGCGCCAGGGCTGATGAGgtaaccgggtcctgaattcggatccagatctgctgtgcc
tt
>HV1300731

Fig. 21 cont.
gtcgacaagaagccaccATGCGCGTGCGCGGCATCCAGCGCAGCTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCAACGCCACCAACGCGACGGACTCGAAGTCCAACATCCTCGAGGGGATGA
AGAACTGCTCCTTCAACATCACGACGGAGCTGCGCGACAAGCGCGAGAAGAAGAACGCCCTGTTCTACAAGCTGGACATCGTGCAGCTGG
GCGGGAACAGCTCGCAGTACAGGCTGATCAACTGCAACACCTCCGTCATCACGCAGGCGTGCCCCAAGGTGTCCTTCGACCCCATCCCCA
TCCACTACTGCGCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACAGCAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCAACATCCGCGAGGCGCACTGCAACATCTCCGAGT
CCAAGTGGAACGAGACCCTGCAGCGCGTGTCCGAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
CGAACAGCACCGACATGGCCAACTCCACCGAGACGAACTCGACGCAGATCATCACGATCCACTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAACAACACGGAGGCACGGAGACCTTCAGGCCAGTGGGAGGCAACATGAAGGACAACTGGTCGTCCGAGCTGTACAAGTACA
AGGTGGTGGAGGTGAAGCCCCTGGGCGTGGCACCCACCAAGGCCCGCAGGCGCGTCGTGGAGCGCGAGAAGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
ACGTGTACTGGAACTCGTCCTGGTCCAACAAGACCTACGACGACATCTGGGACAACATGACCTGGATGCAGTGGGAGCGCGAGATCTCCA
ACTACACCAACATCATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACCGCGTGCGCCAGGGCTGATGAGgttaccgggtcccgaattcggatccagatctgctgtgcc
tt
>HV1300732
gtcgacaagaagccaccATGCGCGTGCGCGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGGAGAACGACATGGTGGACCAGATGCACGAGGACGTGATCTCCCTGTGGGACCAGTCCCTGAAGCCCT
GCGTGCGGCTGACCCCGCTGTGCGTGACCCTGAACTGCATCAACGCCACCAACGCGACGGCCTCGGACTCCAGCATCCTCGACGGGATGA
AGAACTGCTCCTTCAACATCACGACGGAGCTGCGCGACAAGCGCGAGAAGAAGAACGCCCTGTTCTACAAGCTGGACATCGTGCAGCTGG
GCGGGAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACAGCAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCAACATCCGCGAGGCGCACTGCAACATCTCCGAGT
CCAAGTGGAACGAGACCCTGCAGCGCGTGTCCGAGAAGCTGAAGAAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
CGACGTCCACCGACCTCGCCAACTCCACCGAGACGAACATCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
ACAACACGGAGGCACGGAGACCTTCAGGCCAGTGGGAGGCAACATGAAGGACAACTGGTCGTCCGAGCTGTACAAGTACAAGGTGGTGG
AGGTGAAGCCCCTGGGCGTGGCACCCACCAACGCCCGCAGGCGCGTCGTGAAGAGGGAGAAGCGCGCCGTGGGCATGGGCGCCATGTTCC
TGGGCTTCCTGGGCGCTGCGGGCTCCACCATGGGTGCCGCGTCCATCACCCTGACCGTGCAGGCCCGCCAGCTGCTCTCCGGCATCGTGC
AGCAGCAGTCCAACCTCCTGAAGGCCATCGAGGCCCAGCAGCACATGCTGAAGCTGACCGTGTGGGGCATCAAGCAGCTGCAGGCCAGGG
TGCTCGCGCTCGAGCGCTACCTGAAGGACCAGCAGCTGCTCGGCATGTGGGGCTGCTCCGGCAAGCTGATCTGCACCACCAACGTGTACT
GGAACTCGTCCTGGTCCAACAAGACCTACGACGACATCTGGGACAACATGACCTGGATGCAGTGGGAGCGCGAGATCTCCAACTACACCG
AGCTCATCTACGAGCTCCTCGAGGAGTCCCAGAACCAGCAGGAGAAGAACGAGCAGGATCTGCTCGCGCTGGACCGCTGGAACTCCCTGT
GGAACTGGTTCAACATCACCAACTGGCTGTGGTACATCAAGATCTTCATCATGATCGTGGGCGGCCTGATCGGCCTGCGCATCATCTTCG
CCGTGCTGTCGCTGGTGAACCGCGTGCGCCAGGGCTGATGAGgttaccaggacccgaattcggatccagatctgctgtgccttt
>HV1300733
gtcgacaagaagccaccATGCGCGTGATGGGCAGGCAGCGCAACTACCCGCAGTGGTGGATCTGGTCGATGCTGGGCCTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGGCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGGAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACGGACGCCAACGCCACCGCGTCGAACGCCAACGCGACCGTGAGCAACACGA
ACGCGACGGTGTCGAACGACTCCTCCATCATCGAGGAGATGAAGAACTGCTCCTTCAACATCACGACGGAGCTGCGCGACAAGATCGAGA

Fig. 21 cont.
```
AGAAGTACGCCCTGTTCTACAAGCTGGACATCGTGCAGCTGGACGGCAACTCCACGCACTACCGCTTCATCAACTGCAACACCTCCGCGA
TCACGCAGGCGTGCCCCAAGGTGTCCTTCGACCCCATCCCCATCCACTACTGCGCCCCCGCCGGCTACGCCATCCTGAAGTGCAACAACA
AGACCTTCAACGGCACCGGCCCGTGCAACAACGTGTCCACCGTGCAGTGCACGCACGGGATCAAGCCCGTGGTGTCCACGCAGCTGCTCC
TGAACGGGTCGCTGGCCGAGGGCGAGATCATCATCCGGTCGAAGAACATCACGGACAACGGGAAGACCATCATCGTGCACCTGAACGAGT
CCGTGAAGATCGAGTGCACCCGCCCGTCCAACAACACGCGCACCTCCATCGGGATCGGCCCTGGCCAGGCCTTCTACGCCACCGGCCAGG
TCATCGGCGACATCCGCAAGGCGCACTGCAACATCTCCGAGTCCAAGTGGAACGAGACCCTGCAGCGCGTGTCCAAGAAGCTGAAGGAGT
ACTTCCCCGGCAAGAACATCACCTTCCAGCCGTCGTCCGGCGGCGACCCCGAAGTGACCACGCACTCCTTCAACTGCGGTGGCGAGTTCT
TCTACTGCAACACGTCGTCCCTGTTCAACCGCACCTACATGACGAACAGCACGGACATGGCGAACTCCACCGAGACCAACCGCACCATCA
CGATCCACTGCCGCATCAAGCAGATCATCAACATGTGGCAGGAGGTGGGCCGCGCCATGTACGCACCGCCCATCGCCGGCAACATCACCT
GCATCTCCAACATCACCGGCCTCCTGCTGACCCGCGACGGCGGCAACTCGTCCACGGAGACCGAGACCTTCAGGCCAGAGGGAGGCAACA
TGAAGGACAACTGGCGCTCCGAGCTGTACAAGTACAAGGTGGTGGAGGTGAAGCCCCTGGGCGTGGCACCCACCAACGCCCGCAGGCGCG
TCGTGGAGCGCGAGAAGCGCCGTGGCATGGGCGCCGTGTTCCTGGGCTTCCTGGGCGCTGCGGGCTCCACCATGGGTGCCGCGTCCA
TCACCCTGACCGTGCAGGCCCGCCAGCTGCTCTCCGGCATCGTGCAGCAGCAGTCCAACCTCCTGAAGGCCATCGAGGCCCAGCAGCACA
TGCTGCGGCTGACCGTGTGGGGCATCAAGCAGCTGCAGGCCAGGGTGCTCGCGCTCGAGCGCTACCTGAAGGACCAGCAGCTGCTCGGCA
TGTGGGGCTGCTCCGGCAAGCTGATCTGCACCACCAACGTGTACTGGAACTCGTCCTGGTCCAACAAGACCTACGACGACATCTGGGACA
ACATGACCTGGATGCAGTGGGAGGGGGAGATCTCCAACTACACCAACATCATCTACGACCTCCTCGAGGAGTCCCAGAACCAGCAGGAGA
AGAACGAGCAGGATCTGCTCGCGCTGGACCGCTGGAACTCCCTGTGGAACTGGTTCAACATCACCAAGTGGCTGTGGTACATCAAGATCT
TCATCATGATCGTGGGCGGCCTGATCGGCCTGCGCATCATCTTCGCCGTGCTGTCGCTGGTGAACCGCGTGCGCCAGGGCTGATGAGgtt
accaggtcccgaattcggatccagatctgctgtgccctt
>HV1300734
gtcgacaagaagccaccATGCGCGTGCGCGGCATCCAGCGCAGCTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCAACGCCACCAACGCGACGGACTCGAAGTCCAACATCCTCGAGGGGATGA
AGAACTGCTCCTTCAACATCACGACGGAGCTGCGCGACAAGCGCGAGAAGAAGAACGCCCTGTTCTACAAGCTGGACATCGTGCAGCTGG
GCTCCAACAGCTCGCAGTACAGGCTGATCAACTGCAACACCTCCGTCATCACGCAGGCGTGCCCCAAGGTGTCCTTCGACCCCATCCCCA
TCCACTACTGCGCCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACAGCAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCAACATCCGCGAGGCGCACTGCAACATCTCCGAGT
CCAAGTGGAACGAGACCCTGCAGCGCGTGTCCGAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
CGAACAGCACCGACATGGCCAACTCCACCGAGACCAACTCGACGCAGATCATCACGATCCACTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAACAACACGGAGGACACGGAGACCTTCAGGCCAGTGGGAGGCAACATGAAGGACAACTGGCGTCGTCCGAGCTGTACAAGTACA
AGGTGGTGGAGGTGAAGCCCCTGGGCGTGGCACCCACCAACGCCCGCAGGCGCGTCGTGGAGCGCGAGAAGCGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
ACGTGTACTGGAACTCGTCCTGGTCCAACAAGACCTACGACGACATCTGGGACAACATGACCTGGATGCAGTGGGAGCGCGAGATCTCCA
ACTACACCAACATCATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACCGCGTGCGCCAGGGCTGATGAGgttaccgggacctgaattcggatccagatctgctgtgcc
tt
>HV1300735
gtcgacaagaagccaccATGCGCGTGCGCGGCATCCAGCGCAGCTACCCGCAGTGGTGGATCTGGTCGATGCTGGGCCTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGGAGAACGACATGGTGGACCAGATGCACGAGGACGTGATCTCCCTGTGGGACCAGTCCCTGAAGCCCT
GCGTGCGGCTGACCCCGCTGTGCGTGACCCTGAACTGCATCAACGCCACCAACGCGACGGCCTCGGACTCCAGCATCCTCGACGGGATGA
AGAACTGCTCCTTCAACATCACGACGGAGCTGCGCGACAAGCGCGAGAAGAAGAACGCCCTGTTCTACAAGCTGGACATCGTGCAGCTGG
GCGGGAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACAGCAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCAACATCCGCGAGGCGCACTGCAACATCTCCGAGT
```

Fig. 21 cont.
```
CCAAGTGGAACGAGACCCTGCAGCGCGTGTCCGAGAAGCTGAAGAAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
CGACGTCCACCGACATGGCCAACTCCACCGAGACGAACATCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCGCGACGGCGGCA
ACAACACGGAGGACACGGAGACCTTCAGGCCAGTGGGAGGCAACATGAAGGACAACTGGTCGTCCGAGCTGTACAAGTACAAGGTGGTGG
AGGTGAAGCCCCTGGGCGTGGCACCCACCAACGCCCGCAGGCGCGTCGTGGAGAGGGAGAAGCGCGCCGTGGGCATGGGCGCCGTGTTCC
TGGGCTTCCTGGGCGCTGCGGGCTCCACCATGGGTGCCGCGTCCATCACCCTGACCGTGCAGGCCCGCCAGCTGCTCTCCGGCATCGTGC
AGCAGCAGTCCAACCTCCTGAAGGCCATCGAGGCCCAGCAGCACATGCTGAAGCTGACCGTGTGGGGCATCAAGCAGCTGCAGGCCAGGG
TGCTCGCGCTCGAGCGCTACCTGAAGGACCAGCAGCTGCTCGGCATGTGGGGCTGCTCCGGCAAGCTGATCTGCACCACCAACGTGTACT
GGAACTCGTCCTGGTCCAACAAGACCTACAGCGACATCTGGGACAACATGACCTGGATGCAGTGGGAGCGCGAGATCTCCAACTACACCG
ACATGATCTACGAGCTCCTCGAGGAGTCCCAGAACCAGCAGGAGAAGAACGAGCAGGATCTGCTCGCGCTGGACCGCTGGAACTCCCTGT
GGAACTGGTTCAACATCACCAACTGGCTGTGGTACATCAAGATCTTCATCATGATCGTGGGCGGCCTGATCGGCCTGCGCATCATCTTCG
CCGTGCTGTCGCTGGTGAACCGCGTGCGCCAGGGCTGATGAGgttaccgggtcctgaattcggatccagatctgctgtgccttt
>HV1300736
gtcgacaagaagccaccATGCGCGTGCGCGGCATCCAGCGCAGCTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGGAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCAACGCCACCAACGCGACGGCCTCGGACTCCAGCATCCTCGACGGGATGA
AGAACTGCTCCTTCAACATCACGACGGAGCTGCGCGACAAGCGCGAGAAGAAGAACGCCCTGTTCTACAAGCTGGACATCGTGCAGCTGG
GCAGCAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACAGCAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCAACATCCGCGAGGCGCACTGCAACATCTCCGAGT
CCAAGTGGAACGAGACCCTGCAGCGCGTGTCCGAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
CGAACTCCACCGACATGGCCAACTCCACCGAGACGAACAGCACGCAGATCATCACGATCCACTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAACAACACGGAGGACACGGAGACCTTCAGGCCAGTGGGAGGCAACATGAAGGACAACTGGTCGTCCGAGCTGTACAAGTACA
AGGTGGTGGAGGTGAAGCCCCTGGGCGTGGCACCCACCAACGCCCGCAGGCGCGTCGTGGAGAGGGAGAAGCGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
ACGTGTACTGGAACTCGTCCTGGTCCAACAAGACCTACAGCGACATCTGGGACAACATGACCTGGATGCAGTGGGAGCGCGAGATCTCCA
ACTACACCGAGATCATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACCGCGTGCGCCAGGGCTGATGAGgtgaccgaattcggatccagatctgctgtgccttt
>HV1300737
gtcgacaagaagccaccATGCGCGTGCGCGGCATCCAGCGCAGCTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGGAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCATCAACGCCACCAACGCGACGGCCTCGGACTCCAGCATCCTCGACGGGATGA
AGAACTGCTCCTTCAACATCACGACGGAGCTGCGCGACAAGCGCGAGAAGAAGAACGCCCTGTTCTACAAGCTGGACATCGTGCAGCTGG
GCGGGAACTCCTCGCAGTACAGGCTGATCAACTGCAACACCTCCGTCATCACGCAGGCGTGCCCCAAGGTGTCCTTCGACCCCATCCCCA
TCCACTACTGCGCCCCGCCGGCTACGCCATCCTGAAGTGCAACAACAAGACCTTCAACGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCATCATCCGGTCGA
AGAACATCACGGACAACAGCAAGACCATCATCGTGCACCTGAACGAGTCCGTGAAGATCGAGTGCACCCGCCCGAGCAACAACACGCGCA
CCTCCATCCGGATCGGCCCTGGCCAGGCCTTCTACGCCACCGGCCAGGTGATCGGCAACATCCGCGAGGCGCACTGCAACATCTCCGAGT
CCAAGTGGAACGAGACCCTGCAGCGCGTGTCCGAGAAGCTGAAGGAGTACTTCCCCGACAAGAACATCACCTTCCAGCCGTCGTCCGGCG
GCGACCTCGAGATCACCACGCACTCCTTCAACTGCGGTGGCGAGTTCTTCTACTGCAACACGTCGTCCCTGTTCAACCGCACCTACATGG
CGAACTCCACCGACATGGCCAACTCCACCGAGACGAACAGCACGCAGATCATCACGATCCACTGCCGCATCAAGCAGATCATCAACATGT
GGCAGGAGGTGGGCCGCGCCATGTACGCACCGCCCATCGCCGGCAACATCACCTGCATCTCCAACATCACCGGCCTCCTGCTGACCCGCG
ACGGCGGCAACAACACGGAGGACACGGAGACCTTCAGGCCAGTGGGAGGCAACATGAAGGACAACTGGTCGTCCGAGCTGTACAAGTACA
AGGTGGTGGAGGTGAAGCCCCTGGGCGTGGCACCCACCAACGCCCGCAGGCGCGTCGTGGAGAGGGAGAAGCGCGCCGTGGGCATGGGCG
CCGTGTTCCTGGGCTTCCTGGGCGCTGCGGGCTCCACCATGGGTGCCGCGTCCATCACCCTGACCGTGCAGGCCCGCCAGCTGCTCTCCG
```

Fig. 21 cont.
GCATCGTGCAGCAGCAGTCCAACCTCCTGAAGGCCATCGAGGCCCAGCAGCACATGCTGAAGCTGACCGTGTGGGGCATCAAGCAGCTGC
AGGCCAGGGTGCTCGCGCTCGAGCGCTACCTGAAGGACCAGCAGCTGCTCGGCATGTGGGGCTGCTCCGGCAAGCTGATCTGCACCACCA
ACGTGTACTGGAACTCGTCCTGGTCCAACAAGACCTACAGCGACATCTGGGACAACATGACCTGGATGCAGTGGGAGCGCGAGATCTCCA
ACTACACCGACATGATCTACAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGATCGGCCTGCGCA
TCATCTTCGCCGTGCTGTCGCTGGTGAACCGCGTGCGCCAGGGCTGATGAGgtcaccgaattcggatccagatctgctgtgcctt
>HV1300738
gtcgacaagaagccaccATGCGCGTGATGGGCAGGCAGCGCAACTACCCGCAGTGGTGGATCTGGAGCACGCTGGGCCTCAGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCGTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGGAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACGGACGCCAACGCCACCGCGTCGAACGCCAACGCGACCGTGAGCAACACGA
ACGCGACGGTGTCGAACGACTCCTCCATCATCGAGGAGATGAAGAACTGCTCCTTCAACATCACGACGGAGCTGCGCGACAAGATCGAGA
AGAAGTACGCCCTGTTCTACAAGCTGGACATCGTGCAGCTGGACGGCAACTCCACGCACTACCGCTTCATCAACTGCAACACCTCCGCGA
TCACGCAGGCCGTGCCCCAAGGTGTCCTTCGACCCCATCCCCATCCACTACTGCGCCCCGCCGGCTACGCCATCCTGAAGTGCAACAACA
AGACCTTCAACGGCACCGGCCCGTGCAACAACGTGTCCACCGTGCAGTGCACGCACGGGATCAAGCCCGTGGTGTCCACGCAGCTGCTCC
TGAACGGGTCGCTGGCCGAGGGCGAGATCATCATCCGGTCGGAGAACATCACGGACAACGCGAAGACCATCATCGTGCACCTGAACGAGT
CCGTGAAGATCGAGTGCACCCGCCCGTCCAACAACACGCGCACCTCCATCGGGATCGGCCCTGGCCAGGCCTTCTACGCCACCGGCCAGG
TCATCGGCGACATCCGCAAGGCGCACTGCAACATCTCCGAGTCCAAGTGGAACGAGACCCTGCAGCGCGTGTCCAAGAAGCTGAAGGAGT
ACTTCCCCGGCAAGAACATCACCTTCCAGCCGTCGTCCGGCGGCGACCCCGAAGTGACCACGCACTCCTTCAACTGCGGTGGCGAGTTCT
TCTACTGCAACACGTCGTCCCTGTTCAACCGCACCTACATGACGAACAGCACGGACATGGCGAACTCCACCGAGACCAACCGCACCATCA
CGATCCACTGCCGCATCAAGCAGATCATCAACATGTGGCAGGAGGTGGGCCGCGCCATGTACGCACCGCCCATCGCCGGCAACATCACCT
GCATCTCCAACATCACCGGCCTCCTGCTGACCCGCGACGGCGGCAACAACGGGACCCCGAGATCTTCAGGCCAGGCGGAGGCAACATGA
AGGACAACTGGCGCTCCGAGCTGTACAAGTACAAGGTGGTGGAGGTGAAGCCCCTGGGCGTGGCCACCCACCAACGCCCGCAGGCGCGTCG
TGGAGCGCGAGAAGCGCGCCGTGGGCATGGGCGCCGTGTTCCTGGGCTTCCTGGGCGCTGCGGGCTCCACCATGGGTGCCGCGTCCATCA
CCCTGACCGTGCAGGCCCGCCAGCTGCTCTCCGGCATCGTGCAGCAGCAGTCCAACCTCCTGAAGGCCATCGAGGCCCAGCAGCACATGC
TGAAGCTGACCGTGTGGGGCATCAAGCAGCTGCAGGCCAGGGTGCTCGCGCTCGAGCGCTACCTGAAGGACCAGCAGCTGCTCGGCATGT
GGGGCTGCTCCGGCAAGCTGATCTGCACCACCAACGTGTACTGGAACTCGTCCTGGTCCAACAAGACCTACGGCGACATCTGGGACAACA
TGACCTGGATGCAGTGGGAGAGCGAGATCAGCAACTACACCAACATCATCTACGACCTCCTCGAGGAGTCCCAGAACCAGCAGGAGAAGA
ACGAGCAGGATCTGCTCGCGCTGGACCGCTGGAACTCCCTGTGGAACTGGTTCAACATCACCAAGTGGCTGTGGTACATCAAGATCTTCA
TCATGATCGTGGGCGGCCTGATCGGCCTGCGCATCATCTTCGCCGTGCTGTCGCTGGTGAACCGCGTGCGCCAGGGCTGATGAGgtaacc
gaattcggatccagatctgctgtgcctt
>HV1300748
gtcgacaagaagccaccATGCGCGTGATGGGCATCCAGCGCAACTACCCGCAGTGGTGGATCTGGTCGATGCTGGGCTTCTGGATGCTCA
TGATCTGCAACGGCATGTGGGTGACGGTGTACTACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGTGCTGAAGAACG
TGACCGAGAACTTCAACATGTGGAAGAACGACATGGTGGACCAGATGCACGAGGACGTGATCTCCCTGTGGGACCAGTCCCTGAAGCCCT
GCGTGAAGCTGACCCCGCTGTGCGTGACCCTGAACTGCACCAACGCCACCGCGAACAACTCCAACATCATCGAGGAGATGAAGAACTGCT
CCTTCAACATCACGACGGAGCTGCGCGACAAGCGCGAGAAGAAGAACGCCCTGTTCTACAAGCTGGACATCGTGCAGCTGGACGGCAACT
CCTCGCAGTACAGGCTGATCAACTGCAACACCTCCGTCATCACGCAGGCGTGCCCCAAGGTGTCCTTCGACCCCATCCCCATCCACTACT
GCGCCCCCGCCGGCTACGCCATCCTGAAGTGCAACAACAAGACCTTCACCGGCACCGGCCCGTGCAACAACGTGTCCACCGTGCAGTGCA
CGCACGGGATCAAGCCCGTGGTGTCCACGCAGCTGCTCCTGAACGGGTCGCTGGCCGAGGGCGAGATCATCATCCGGTCGGAGAACATCA
CGAACAACGTGAAGACCATCATCGTGCACCTGAACGAGTCCGTGAAGATCGAGTGCACCCGCCCGAACAACAAGACGCGCACCTCCATCC
GGATCGGCCCTGGCCAGGCCTTCTACGCCACCGGCCAGGTGATCGGCGACATCCGCAGGCGTACTGCAACATCAACGAGTCCAAGTGGA
ACGAGACCCTGCAGCGCGTGTCCAAGAAGCTGAAGGAGTACTTCCCCCACAAGAACATCACCTTCCAGCCGTCGTCCGGCGGCGACCTCG
AGATCACCACGCACTCCTTCAACTGCGGTGGCGAGTTCTTCTACTGCAACACGTCGTCGCTGTTCAACCGCACCGACATGGCCAACTCCA
CCGAGACCAACTCCACGCGCACCATCACGATCCACTGCCGCATCAAGCAGATCATCAACATGTGGCAGGAGGTGGGCCGCGCCATGTACG
CACCGCCCATCGCCGGCAACATCACCTGCATCTCCAACATCACCGGCCTCCTGCTGACCCGCGACGGCGGCAAGAACAACACGGAGACCT
TCAGGCCAGGCGGAGGCAACATGAAGGACAACTGGCGCTCCGAGCTGTACAAGTACAAGGTGGTGGAGGTGAAGCCCCTGGGCGTGGCAC
CCACCAACGCCCGCAGGCGCGTCGTGGAGCGCGAGAAGCGCGCCGTGGGCATGGGCGCCGTGTTCCTGGGCTTCCTGGGCGCTGCGGGCT
CCACCATGGGTGCCGCGTCCATCACCCTGACCGTGCAGGCCCGCCAGCTGCTCTCCGGCATCGTGCAGCAGCAGTCCAACCTCCTGAAGG
CCATCGAGGCCCAGCAGCACATGCTGAAGCTGACCGTGTGGGGCATCAAGCAGCTGCAGGCCAGGGTGCTCGCGCTCGAGCGCTACCTGA
AGGACCAGCAGCTGCTCGGCATGTGGGGCTGCTCCGGCAAGCTGATCTGCACCACCAACGTGTACTGGAACTCGTCCTGGTCCAACAAGA
CCTACGGCGACATCTGGGACAACATGACCTGGATGCAGTGGGAGGCGAGATCTCCAACTACACCGATCATCTACGAGCTCCTCGAGG
AGTCCCAGAACCAGCAGGAGAAGAACGAGCAGGATCTGCTCGCGCTGGACCGCTGGAACTCCCTGTGGAACTGGTTCAACATCACCAACT
GGCTGTGGTACATCAAGATCTTCATCATGATCGTGGGCGGCCTGATCGGCCTGCGCATCATCTTCGCCGTGCTGTCGCTGGTGAACCGCG
TGCGCCAGGGCTGATGAGtggatccagatctgctgtgcctt
>HV1300756

Fig. 21 cont.

```
gtcgacaagaagccaccATGCGCGTGATGGGCATCCAGCGCAACTACCCGCAGTGGTGGATCTGGTCGATGCTGGGCTTCTGG
ATGCTCATGATCTGCAACGGCATGTGGGTGACGGTGTACTACGGCGTGCCGGTGTGGAAGGAGGCCAAGACGACCCTGTTCTG
CGCGTCGGACGCCAAGGCCTACGAGAAGGAGGTGCACAACGTGTGGGCGACCCACGCCTGCGTGCCCACGGACCCCAACCCGC
AGGAGATGGTGCTGAAGAACGTGACCGAGAACTTCAACATGTGGAAGAACGACATGGTGGACCAGATGCACGAGGACGTGATC
TCCCTGTGGGACCAGTCCCTGAAGCCCTGCGTGAAGCTGACCCCGCTGTGCGTGACCCTGAACTGCACCAACGCGACGGCCCG
GAACTGCACGAACGCCACCGCGTCCAACTCCTCCATCATCGAGGGCATGAAGAACTGCTCCTTCAACATCACGACGGAGCTGC
GCGACAAGCGCGAGAAGAAGAACGCCCTGTTCTACAAGCTGGACATCGTGCAGCTGGACGGCAACTCCTCGCAGTACAGGCTG
ATCAACTGCAACACCTCCGTCATCACGCAGGCGTGCCCCAAGGTGTCCTTCGACCCCATCCCCATCCACTACTGCGCCCCCGC
CGGCTACGCCATCCTGAAGTGCAACAACAAGACCTTCACCGGCACCGGCCCGTGCAACAACGTGTCCACCGTGCAGTGCACGC
ACGGGATCAAGCCCGTGGTGTCCACGCAGCTGCTCCTGAACGGGTCGCTGGCCGAGGGCGAGATCATCATCCGGTCCGAGAAC
ATCACGAACAGCGGGAAGACCATCATCGTGCACCTGAACGAGTCCGTGAAGATCGAGTGCACCCGCCCGAACAACAAGACGCG
CACCTCCATCCGGATCGGCCCTGGCCAGGCCTTCTACGCCACCGGCCAGGTGATCGGCGACATCCGCGAGGCGTACTGCAACA
TCTCGGAGTCCAAGTGGAACGAGACCCTGCAGCGCGTGTCCAAGAAGCTGAAGGAGTACTTCCCCCACAAGAACATCACCTTC
CAGCCGTCGTCCGGCGGCGACCTCGAGATCACCACGCACTCCTTCAACTGCGGTGGCGAGTTCTTCTACTGCAACACGTCGTC
GCTGTTCAACCGCACCTACATGGCCAACTCCACCGACATGGCCAACTCCACCGAGACCAACTCCACGCGCATCATCACGATCC
ACTGCCGCATCAAGCAGATCATCAACATGTGGCAGGAGGTGGGCCGCGCCATGTACGCACCGCCCATCGCCGGCAACATCACC
TGCATCTCCAGCATCACCGGCCTCCTGCTGACCCGCGACGGCGGCGAGAACAACACGGAGACCTTCAGGCCAGGCGGAGGCAA
CATGAAGGACAACTGGCGCTCCGAGCTGTACAAGTACAAGGTGGTGGAGGTGAAGCCCCTGGGCGTGGCACCCACCAACGCCC
GCAGGCGCGTCGTGGAGCGCGAGAAGCGCGCCGTGGGCATGGGCGCCGTGTTCCTGGGCTTCCTGGGCGCTGCGGGCTCCACC
ATGGGTGCCGCGTCCATCACCCTGACCGTGCAGGCCCGCCAGCTGCTCTCCGGCATCGTGCAGCAGCAGTCCAACCTCCTGAA
GGCCATCGAGGCCCAGCAGCACATGCTGAAGCTGACCGTGTGGGGCATCAAGCAGCTGCAGGCCAGGGTGCTCGCGCTCGAGC
GCTACCTGAAGGACCAGCAGCTGCTCGGCATGTGGGGCTGCTCCGGCAAGCTGATCTGCACCACCAACGTGTACTGGAACTCG
TCCTGGTCCAACAAGACCTACGGCGACATCTGGGACAACATGACCTGGATGCAGTGGGAGCGCGAGATCTCCAACTACACCGA
GATCATCTACGAGCTCCTCGAGGAGTCCCAGAACCAGCAGGAGAAGAACGAGCAGGATCTGCTCGCGCTGGACCGCTGGAACT
CCCTGTGGAACTGGTTCAACATCACCAACTGGCTGTGGTACATCAAGATCTTCATCATGATCGTGGGCGGCCTGATCGGCCTG
CGCATCATCTTCGCCGTGTTCTCGCTGGTGAACCGCGTGCGCCAGGGCTGATGAGggacctgaattcggtaaccggatccaga
tctgctgtgcctt
```

Fig. 28

| Name | Mutation |
|---|---|
| T/F | |
| M14 | S364P |
| M15 | S375H |
| M16 | T202K |
| M17 | L520F |
| M18 | G459E |
| M22 | S375H + T202K |
| M23 | S375H + T202K + L520F |
| M24 | S375H + T202K + L520F + G459E |
| M25 | S375H + T202K + G459E |
| M26 | T202K + L520F + G459E |

Fig. 31

>HV13284 (TC_M_mos_3_1 gp160) (2582bp)

```
gtcgacaagaaATGAGGGTCAAGGGCATCAGGAAGAACTACCAGCACCTCTGGAGGTGGGGCACGATGCTCCTGGGGA
TGCTGATGATCTGCAGCGCGGCTGAGCAGCTGTGGGTGACCGTGTACTACGGCGTGCCTGTGTGGCGGGACGCCGAGA
CCACCCTGTTCTGTGCCTCGGACGCCAAGGCCTACGAGCGGGAGGTCCACAACGTGTGGGCTACCCACGCCTGTGTGC
CCACCGATCCCAACCCGCAGGAGATCGTCCTGGAGAACGTGACCGAGGAGTTCAACATGTGGAAGAACAACATGGTGG
ACCAGATGCACGAGGACATCATCAGCCTGTGGGACGAGAGCCTGAAGCCCTGCGTGAAGCTGACCCCCCTGTGTGTGA
CCCTGAACTGCACGGACGTGAACGTGACCAAGACCAACTCGACGTCCTGGGGGATGATGGAGAAGGGGGAGATCAAGA
ACTGTAGCTTCAACATGACCACCGAGCTGCGGGACAAGAAGCAGAAGGTGTACGCCCTGTTCTACAAGCTGGACATCG
TGCCGCTGGAGGAGAACGACACCATCTCCAACAGCACCTACAGGCTGATCAACTGCAACACCAGCGCGATCACCCAGG
CCTGCCCCAAGGTCACCTTCGAGCCCATCCCCATCCACTACTGCACGCCTGCCGGCTTCGCCATCCTGAAGTGCAACG
ACAAGAAGTTCAACGGCACCGGCCCCTGCAAGAACGTCAGCACCGTCCAGTGCACCCACGGCATCCGGCCTGTGGTGA
CGACCCAGCTGCTCCTGAACGGCAGCCTGGCCGAGGAGGAGATCATCATCAGGAGCGAGAACCTCACCAACAACGCCA
AGACGATCATCGTGCAGCTGAACGAGTCGGTGGTGATCAACTGTACCCGGCCCAACAACAACACCCGGAAGAGCATCC
GGATCGGCCCTGGACAGACCTTCTACGCGACGGGCGACATCATCGGCAACATCAGACAGGCCCACTGCAACATCTCGC
GGGAGAAGTGGATCAACACCACGAGGGACGTCAGGAAGAAGCTGCAGGAGCACTTCAACAAGACCATCATCTTCAACA
GCAGCAGCGGCGGAGACCTGGAGATCACCACGCACTCGTTCAACTGTCGGGGCGAGTTCTTCTACTGCAACACATCGA
AGCTGTTCAACAGCGTCTGGGGCAACAGCTCGAACGTGACGAAGGTGAACGGCACGAAGGTCAAGGAGACGATCACAC
TGCCCTGCAAGATCAAGCAGATCATCAACATGTGGCAGGAGGTGGGCCGGGCTATGTACGCCCCTCCCATCGCGGGCA
ACATCACGTGCAAGAGCAACATCACCGGCCTGCTCCTAGTGAGAGACGGCGGCAACGTCACGAACAACACCGAGATCT
TCAGGCCTGGCGGCGGAAACATGAAGGACAACTGGCGGAGCGAGCTGTACAAGTACAAGGTCGTGGAGATCAAGCCCC
TGGGCATCGCACCCACCAAGGCCAAGAGAAGGGTGGTGGAGCGGGAGAAGAGAGCGGTCGGACTGGGCGCCGTGTTCC
TGGGCTTCCTGGGAGCAGCCGGAAGCACCATGGGAGCCGCCTCGATGACCCTGACCGTGCAGGCGAGGCAGCTGCTGT
CCGGCATCGTGCAGCAGCAGTCGAACCTGCTGAGGGCCATCGAGGCCCAGCAGCACATGCTCCAGCTGACCGTGTGGG
GCATCAAGCAGCTCCAGGCCCGAATCCTGGCCGTCGAGCGCTACCTGCGGGACCAGCAGCTGCTCGGCATCTGGGGCT
GTAGCGGCAAGCTGATCTGTACCACCAACGTGCCCTGGAACAGCAGCTGGAGCAACAAGAGCCTCGACGAGATCTGGA
ACAACATGACCTGGATGCAGTGGGAGAAGGAGATCGACAACTACACCAGCCTCATCTACACGCTGATCGAGGAGAGCC
AGAACCAGCAGGAGAAGAACGAGCAGGACCTGCTGGCGCTGGACAAGTGGGCGAACCTGTGGAACTGGTTCGACATCA
GCAACTGGCTGTGGTACATCCGGATCTTCATCATGATCGTCGGCGGCCTGATCGGTCTGAGAATCGTCTTCGCCGTGC
TGTCCATCGTGAACCGAGTGAGGAAGGGCTACAGCCCCCTGAGCTTCCAAACCCTGACGCCGAACCCGAGAGGCCCCG
ACCGGCTCGGGAGGATCGAGGAGGAGGGAGGAGAGCAGGACAAGGACAGGTCCATCAGGCTCGTCAACGGCTTCCTGG
CACTCGCCTGGGACGACCTGAGGAACCTGTGCCTGTTCAGCTACCACCGGCTGAGGGACCTCCTGCTGATCGTCACCC
GGATCGTCGAGCTGCTGGGCCGGAGAGGCTGGGAGGCCCTGAAGTACCTGTGGAACCTGCTCCAGTACTGGATACAGG
AGCTGAAGAACAGCGCCGTGTCCCTGCTGAACGCCACGGCGATCGCGGTGGCCGAGGGAACCGACCGGGTCATCGAGG
TGGTGCAGCGCGCCTGCAGGGCCATCCTGCACATCCCCCGGCGAATCCGCCAGGGCCTGGAGCGCGCCCTGCTCTGAT
GAggatcc_
```

>TC_ M_mos_3_1 gp160

```
MRVKGIRKNYQHLWRWGTMLLGMLMICSAAEQLWVTVYYGVPVWRDAETTLFCASDAKAYEREVHNVWATHACVPTDP
NPQEIVLENVTEEFNMWKNNMVDQMHEDIISLWDESLKPCVKLTPLCVTLNCTDVNVTKTNSTSWGMMEKGEIKNCSF
NMTTELRDKKQKVYALFYKLDIVPLEENDTISNSTYRLINCNTSAITQACPKVTFEPIPIHYCTPAGFAILKCNDKKF
NGTGPCKNVSTVQCTHGIRPVVTTQLLLNGSLAEEEIIIRSENLTNNAKTIIVQLNESVVINCTRPNNNTRKSIRIGP
GQTFYATGDIIGNIRQAHCNISREKWINTTRDVRKKLQEHFNKTIIFNSSSGGDLEITTHSFNCRGEFFYCNTSKLFN
SVWGNSSNVTKVNGTKVKETITLPCKIKQIINMWQEVGRAMYAPPIAGNITCKSNITGLLLVRDGGNVTNNTEIFRPG
GGNMKDNWRSELYKYKVVEIKPLGIAPTKAKRRVVEREKRAVGLGAVFLGFLGAAGSTMGAASMTLTVQARQLLSGIV
QQQSNLLRAIEAQQHMLQLTVWGIKQLQARILAVERYLRDQQLLGIWGCSGKLICTTNVPWNSSWSNKSLDEIWNNMT
WMQWEKEIDNYTSLIYTLIEESQNQQEKNEQDLLALDKWANLWNWFDISNWLWYIRIFIMIVGGLIGLRIVFAVLSIV
NRVRKGYSPLSFQTLTPNPRGPDRLGRIEEEGGEQDKDRSIRLVNGFLALAWDDLRNLCLFSYHRLRDLLLIVTRIVE
LLGRRGWEALKYLWNLLQYWIQELKNSAVSLLNATAIAVAEGTDRVIEVVQRACRAILHIPRRIRQGLERALL*

Fig. 31 (cont.)

>HV13285 (TC_M_mos_3_2 gp160) (2570bp)

gtcgacaagaaATGAGGGTCAAGGAGACGCAGATGAACTGGCCGAACCTCTGGAAGTGGGGCACCCTGATCCTGGGCC
TCGTGATCATCTGCTCCGCGAGCGACAACCTGTGGGTGACGGTGTACTACGGCGTGCCTGTGTGGAAGGAGGCCACCA
CCACCCTGTTCTGCGCCTCGGACGCCAAGGCCTACGACACGGAGGTCCACAACGTGTGGGCTACCTACGCCTGTGTGC
CCACCGATCCCAACCCTCAGGAGGTCGTGCTGGGCAACGTGACCGAGAACTTCAACATGTGGAAGAACAACATGGTGG
AGCAGATGCACGAGGACATCATCAGCCTGTGGGACCAGAGCCTGAAGCCCTGCGTGCGCCTGACCCCGCTGTGCGTGA
CCCTGAACTGCTCCAACGCCAACACCACGAACACCAACTCGACGGAGGAGATCAAGAACTGCAGCTTCAACATCACCA
CCAGCATCCGGGACAAGGTGCAGAAGGAGTACGCCCTGTTCTACAAGCTGGACGTCGTGCCGATCGACAACGACAACA
CCAGCTACAGGCTGATCTCGTGCAACACCAGCGTCATCACCCAGGCCTGCCCCAAAGTTAGCTTCGAGCCCATCCCCA
TCCACTACTGCGCGCCTGCCGGCTTCGCCATCCTGAAGTGCAAGGACAAGAAGTTCAACGGCACCGGCCCCTGCACGA
ACGTCAGCACCGTCCAGTGCACCCACGGCATCAGGCCTGTGGTGTCCACCCAGCTGCTCCTGAACGGCAGCCTGGCCG
AGGAGGAGGTCGTGATCAGGAGCGAGAACTTCACCAACAACGCCAAGACGATCATCGTGCACCTGAACAAGTCGGTGG
AGATCAACTGCACCCGGCCCAACAACAACACCCGGAAGAGCATCCACATCGGCCCTGGACGGGCGTTCTACGCTACGG
GGGAGATCATCGGCGACATCAGGCAGGCCCACTGCAACATCTCGCGGGCCAAGTGGAACAACACCCTGAAGCAGATCG
TGAAGAAGCTGAAGGAGCAGTTCAACAAGACCATCATCTTCAACCAGAGCAGCGGCGGAGACCCGGAGATCACCACGC
ACTCGTTCAACTGTGGTGGCGAGTTCTTCTACTGTAACACGTCCGGGCTGTTCAACAGCACCTGGAACTCGACCGCGA
CGCAGGAGTCTAACAACACCGAGCTGAACGGCAACATCACCCTGCCGTGCCGGATCAAGCAGATCGTCAACATGTGGC
AGGAGGTGGGCAAGGCTATGTACGCCCCTCCCATCCGCGGCCAGATCCGGTGCAGCTCGAACATCACCGGCCTGATCC
TGACCAGGGACGGCGGCAACAACAACTCGACGAACGAGACCTTCAGACCTGGCGGCGGAGACATGCGGGACAACTGGC
GGAGCGAGCTGTACAAGTACAAGGTCGTGAAGATCGAGCCCCTGGGCGTCGCACCCACCAAGGCCAAGCGGAGAGTGG
TGCAGCGGGAGAAGAGGGCGGTGGGAACGATCGGCGCCATGTTCCTGGGCTTCCTGGGAGCGGCCGGAAGCACGATGG
GAGCCGCCTCGCTGACCCTGACCGTGCAGGCGAGGCTCCTGCTGTCCGGCATCGTGCAGCAGCAGAACAACCTGCTGA
GGGCCATCGAGGCCCAGCAGCACCTGCTCCAGCTGACAGTGTGGGGCATCAAGCAGCTCCAGGCGAGGGTGCTGGCCG
TCGAGAGATACCTGAAGGACCAGCAACTGCTCGGCATCTGGGCTGTAGCGGCAAGCTGATCTGTACCACCACCGTGC
CCTGGAACACCAGCTGGAGCAACAAGAGCCTCAACGAGATCTGGGACAACATGACCTGGATGGAGTGGGAGCGGGAGA
TCGACAACTACACAGGGCTCATCTACACGCTGCTGGAGGAGAGCCAGAACCAGCAGGAGAAGAACGAGCAGGAGCTGC
TGGAGCTGGACAAGTGGGCGTCGCTGTGGAATCGGTTCGACATCACCAAGTGGCTGTGGTACATCAAGATCTTCATCA
TGATCGTCGGCGGCCTGGTGGGTCTGAGAATCGTCTTCACGGTGCTGTCCATCGTGAACAGAGTCAGGCAGGGCTACA
GCCCCCTGAGCTTCCAGACCCACCTCCCTGCCCCGAGAGGCCCGATAGACCCGAGGGGATCGAGGAGGAGGGAGGAG
AGCGCGACAGGGACAGGTCCGGCAGGCTTGTAGACGGCTTCCTGGCAATCATCTGGGTCGATCTGAGGAGCCTGTGCC
TGTTCAGCTACCACCAGCTGAGAGACTTCATCCTGATCGCGGCCAGAACCGTGGAGCTGCTGGGCCACAGCTCGCTCA
AGGGTCTCCGGAGAGGCTGGGAGGCCCTGAAGTACTGGTGGAACCTGCTGCAGTACTGGTCGCAGGAGCTGAAGAACA
GCGCCATCTCCCTGCTGAACACGACCGCCATCGTGGTGGCCGAGGGAACCGACAGAATCATCGAGGTGCTGCAGAGAG
CGGGGAGAGCCATCCTGCACATCCCCACGAGAATCAGACAGGGCCTGGAGAGACTGCTGCTCTGATGAggatcc_

>TC_M_mos_3_2
gp160MRVKETQMNWPNLWKWGTLILGLVIICSASDNLWVTVYYGVPVWKEATTTLFCASDAKAYDTEVHNVWATYAC
VPTDPNPQEVVLGNVTENFNMWKNNMVEQMHEDIISLWDQSLKPCVRLTPLCVTLNCSNANTTNTNSTEEIKNCSFNI
TTSIRDKVQKEYALFYKLDVVPIDNDNTSYRLISCNTSVITQACPKVSFEPIPIHYCAPAGFAILKCKDKKFNGTGPC
TNVSTVQCTHGIRPVVSTQLLLNGSLAEEEVVIRSENFTNNAKTIIVHLNKSVEINCTRPNNNTRKSIHIGPGRAFYA
TGEIIGDIRQAHCNISRAKWNNTLKQIVKKLKEQFNKTIIFNQSSGGDPEITTHSFNCGGEFFYCNTSGLFNSTWNST
ATQESNNTELNGNITLPCRIKQIVNMWQEVGKAMYAPPIRGQIRCSSNITGLILTRDGGNNNSTNETFRPGGGDMRDN
WRSELYKYKVVKIEPLGVAPTKAKRRVVQREKRAVGTIGAMFLGFLGAAGSTMGAASLTLTVQARLLLSGIVQQQNNL
LRAIEAQQHLLQLTVWGIKQLQARVLAVERYLKDQQLLGIWGCSGKLICTTTVPWNTSWSNKSLNEIWDNMTWMEWER
EIDNYTGLIYTLLEESQNQQEKNEQELLELDKWASLWNWFDITKWLWYIKIFIMIVGGLVGLRIVFTVLSIVNRVRQG
YSPLSFQTHLPAPRGPDRPEGIEEEGGERDRDRSGRLVDGFLAIIWVDLRSLCLFSYHQLRDFILIAARTVELLGHSS
LKGLRRGWEALKYWWNLLQYWSQELKNSAISLLNTTAIVVAEGTDRIIEVLQRAGRAILHIPTRIRQGLERLLL*

Fig. 31 (cont.)

>HV13286 (TC_M_mos_3_3 gp160) (2615bp)

gtcgacaagaaATGAGGGTCCGGGGAATCCAGAGGAACTGGCCGCAGTGGTGGATCTGGGGCATCCTGGGATTCTGGA
TGCTGATGATCTGCAACGTGGTGGGCAACCTGTGGGTGACCGTGTACTACGGCGTGCCTGTGTGGAAGGAGGCCAAGA
CCACCCTGTTCTGTGCCTCGGACGCCAAGGCCTACGAGAAGGAGGTCCACAACGTGTGGGCTACCCACGCCTGTGTGC
CCACCGACCCCTCGCCTCAAGAGGTCGTGCTGGAGAACGTGACCGAGAACTTCAACATGTGGAAGAACGACATGGTGG
ACCAGATGCACGAGGACGTCATCAGCCTGTGGGACCAGAGCCTGAAGCCCTGCGTGAAGCTGACCCACCTGTGCGTGA
CCCTGAACTGCACGAACGCCACGAACACGAACTACAACAACTCGACGAACGTGACGTCGTCGATGATCGGGGAGATGA
AGAACTGTAGCTTCAACATCACCACCGAGATCCGGGACAAGTCGCGCAAGGAGTACGCCCTGTTCTACCGGCTGGACA
TCGTGCCGCTGAACGAGCAGAACAGCTCGGAGTACAGGCTGATCAACTGTAACACCAGCACCATCACCCAGGCCTGCC
CCAAAGTCAGCTTCGACCCCATCCCCATCCACTACTGCGCGCCTGCCGGCTACGCCATCCTGAAGTGCAACAACAAGA
CGTTCAACGGCACCGGCCCCTGCAACAACGTCAGCACCGTCCAGTGCACCCACGGCATCAAGCCTGTGGTGTCCACCC
AGCTGCTCCTGAACGGCAGCCTGGCCGAGGGCGAGATCATCATCAGGAGCGAGAACCTGACCGACAACGCCAAGACCA
TCATCGTGCACCTGAACGAGTCGGTGGAGATCGTCTGCACCCGGCCCAACAACAACACCCGGAAGAGCGTGCGGATCG
GCCCTGGACAGGCGTTCTACGCCACGGGGGACATCATCGGCGACATCAGGCAGGCCCACTGCAACCTGTCGCGGACCC
AGTGGAACAACACCCTGAAGCAGATCGTGACGAAGCTGAGGGAGCAGTTCGGGAACAAGACCATCGTGTTCAACCAGA
GCAGCGGCGGAGACCCGGAGATCGTGATGCACTCGTTCAACTGCGGTGGCGAGTTCTTCTACTGCAACACGACCCAGC
TGTTCAACAGCACCTGGGAGAACTCCAACATCACCCAGCCCCTGACCCTGAACCGGACCAAGGGGCCTAACGACACCA
TCACGCTGCCGTGCCGGATCAAGCAGATCATCAACATGTGGCAGGGCGTGGGCAGGGCCATGTACGCCCCTCCCATCG
AGGGCCTGATCAAGTGCAGCTCGAACATCACCGGCCTGCTGCTGACCAGAGACGGCGGCAACAACTCGGAGACGAAGA
CCACGGAGACCTTCAGACCTGGCGGCGGAAACATGAGAGACAACTGGCGGAACGAGCTGTACAAGTACAAGGTCGTGC
AGATCGAGCCCCTGGGCGTCGCACCCACCCGGGCCAAGAGGAGAGTGGTGGAGCGGGAGAAGAGAGCGGTGGGAATCG
GCGCCGTGTTCCTGGGCTTCCTGGGAACGGCCGGAAGCACCATGGGAGCCGCCTCGATCACCCTGACCGTGCAGGCGA
GGCAGGTGCTGTCCGGCATCGTGCAGCAGCAGTCGAACCTGCTGAAGGCCATCGAGGCCCAGCAGCACCTGCTCAAGC
TGACAGTGTGGGGCATCAAGCAGCTCCAGACCAGGGTGCTGGCCATCGAGCGCTACCTGAAGGACCAGCAGCTGCTCG
GCCTGTGGGGCTGTAGCGGCAAGCTGATCTGTACCACCGCGGTGCCCTGGAACAGCAGCTGGAGCAACAAGAGCCAGA
CCGACATCTGGGACAACATGACCTGGATGCAGTGGGACCGGGAGATCTCGAACTACACAGACACGATCTACCGGCTGC
TgGAGGACAGCCAGAACCAGCAGGAAGAACGAGAAGGACCTGCTGGCGCTGGACAGCTGGAAGAACCTGTGGAACT
GGTTCGACATCACCAACTGGCTGTGGTACATCAAGATCTTCATCATCATCGTCGGCGGCCTGATCGGTCTGAGAATCA
TCTTCGCCGTGCTGTCCATCGTGAACAGGTGCAGGCAGGGCTACAGCCCCCTGAGCCTGCAGACCCTGATCCCTAACC
CGAGAGGCCCCGACAGGCTCGGAGGGATCGAGGAGGAGGGAGGAGAGCAGGACAGGGACAGGTCCATCAGGCTCGTAT
CGGGCTTCCTGGCACTCGCCTGGGACGACCTGAGGAGCCTGTGCCTGTTCAGCTACCACCGGCTGAGGGACTTCATCC
TGATCGTCGCCCGCGCTGTGGAGCTGCTGGGCAGGTCGAGCCTCCGAGGTCTCCAGAGAGGCTGGGAGGCCCTGAAGT
ACCTGGGCTCTCTGGTCCAGTACTGGGGTCTgGAGCTGAAGAAGAGCGCCATCTCCCTGCTGGACACGATCGCCATCG
CGGTGGCCGAGGGAACCGACAGAATCATCGAAGTGATCCAGAGAATCTGCAGAGCCATCCGGAACATCCCCCGGAGAA
TCAGACAGGGCTTCGAGGCTGCCCTGCTCTGATGAggatcc_

>TC_M_mos_3_3 gp160

MRVRGIQRNWPQWWIWGILGFWMLMICNVVGNLWVTVYYGVPVWKEAKTTLFCASDAKAYEKEVHNVWATHACVPTDP
SPQEVVLENVTENFNMWKNDMVDQMHEDVISLWDQSLKPCVKLTHLCVTLNCTNATNTNYNNSTNVTSSMIGEMKNCS
FNITTEIRDKSRKEYALFYRLDIVPLNEQNSSEYRLINCNTSTITQACPKVSFDPIPIHYCAPAGYAILKCNNKTFNG
TGPCNNVSTVQCTHGIKPVVSTQLLLNGSLAEGEIIIRSENLTDNAKTIIVHLNESVEIVCTRPNNNTRKSVRIGPGQ
AFYATGDIIGDIRQAHCNLSRTQWNNTLKQIVTKLREQFGNKTIVFNQSSGGDPEIVMHSFNCGGEFFYCNTTQLFNS
TWENSNITQPLTLNRTKGPNDTITLPCRIKQIINMWQGVGRAMYAPPIEGLIKCSSNITGLLLTRDGGNNSETKTTET
FRPGGGNMRDNWRNELYKYKVVQIEPLGVAPTRAKRRVVEREKRAVGIGAVFLGFLGTAGSTMGAASITLTVQARQVL
SGIVQQQSNLLKAIEAQQHLLKLTVWGIKQLQTRVLAIERYLKDQQLLGLWGCSGKLICTTAVPWNSSWSNKSQTDIW
DNMTWMQWDREISNYTDTIYRLLEDSQNQQEKNEKDLLALDSWKNLWNWFDITNWLWYIKIFIIIVGGLIGLRIIFAV
LSIVNRCRQGYSPLSLQTLIPNPRGPDRLGGIEEEGGEQDRDRSIRLVSGPLALAWDDLRSLCLFSYHRLRDFILIVA
RAVELLGRSSLRGLQRGWEALKYLGSLVQYWGLELKKSAISLLDTIAIAVAEGTDRIIEVIQRICRAIRNIPRRIRQG
FEAALL*

SWARM IMMUNIZATION WITH ENVELOPES FROM CH505

This application is a U.S. National Stage application under 35 U.S.C. § 371 of International Patent Application No. PCT/US15/21528, filed Mar. 19, 2015, which claims the benefit of and priority to U.S. application Ser. No. 61/955, 402, filed Mar. 19, 2014, entitled "Swarm Immunization With Envelopes From CH505", the content of which application is hereby incorporated by reference in its entirety.

This invention was made with government support under Center for HIV/AIDS Vaccine Immunology-Immunogen Design grant UM1-AI100645 from the NIH, NIAID, Division of AIDS. The government has certain rights in the invention.

SEQUENCE LISTING

The instant application contains a Sequence Listing which has been filed electronically in ASCII format and is hereby incorporated by reference in its entirety. Said ASCII copy, created on Jul. 2, 2018, is named $1234300_{13}00238US1_{13}$SL.txt and is 3,006,767 bytes in size.

TECHNICAL FIELD

The present invention relates in general, to a composition suitable for use in inducing anti-HIV-1 antibodies, and, in particular, to immunogenic compositions comprising envelope proteins and nucleic acids to induce cross-reactive neutralizing antibodies and increase their breadth of coverage. The invention also relates to methods of inducing such broadly neutralizing anti-HIV-1 antibodies using such compositions.

BACKGROUND

The development of a safe and effective HIV-1 vaccine is one of the highest priorities of the scientific community working on the HIV-1 epidemic. While anti-retroviral treatment (ART) has dramatically prolonged the lives of HIV-1 infected patients, ART is not routinely available in developing countries.

SUMMARY OF THE INVENTION

In certain embodiments, the invention provides compositions and method for induction of immune response, for example cross-reactive (broadly) neutralizing Ab induction. In certain embodiments, the methods use compositions comprising "swarms" of sequentially evolved envelope viruses that occur in the setting of bnAb generation in vivo in HIV-1 infection.

In certain aspects the invention provides compositions comprising a selection of HIV-1 envelopes or nucleic acids encoding these envelopes as described herein for example but not limited to Selections as described herein,. In certain embodiments, these compositions are used in immunization methods as a prime and/or boost as described in Selections as described herein.

In one aspect the invention provides selections of envelopes from individual CH505, which selections can be used in compositions for immunizations to induce lineages of broad neutralizing antibodies. In certain embodiments, there is some variance in the immunization regimen; in some embodiments, the selection of HIV-1 envelopes may be grouped in various combinations of primes and boosts, either as nucleic acids, proteins, or combinations thereof. In certain embodiments the compositions are pharmaceutical compositions which are immunogenic.

In one aspect the invention provides a composition comprising any one of the envelopes described herein, or any combination thereof (Tables 13, and 14, selections A-L). In some embodiments, CH505 transmitted/founder (T/F) Env is administered first as a prime, followed by a mixture of a next group of Envs, followed by a mixture of a next group of Envs, followed by a mixture of the final Envs. In some embodiments, grouping of the envelopes is based on their binding affinity for the antibodies expected to be induced. In some embodiments, grouping of the envelopes is based on chronological evolution of envelope viruses that occurs in the setting of bnAb generation in vivo in HIV-1 infection. In Loop D mutants could be included in either prime and/or boost. In some embodiments, the composition comprises an adjuvant. In some embodiments, the composition and methods comprise use of agents for transient modulation of the host immune response.

In one aspect the invention provides a composition comprising nucleic acids encoding HIV-1 envelope w000.T/F (or w004.03) and a loop D mutant, e.g. M11 or any other suitable D loop mutant or combination thereof. In some embodiments, the compositions and methods of the invention comprise use of any one of the mutant in FIG. 30, e.g., M14 and/or M24. A composition comprising nucleic acids encoding HIV-1 envelope w000.T/F (or w004.03), M11, w014.32, and w014.12. A composition comprising nucleic acids encoding HIV-1 envelope T/F (or w004.03), M11, w030.28, w053.16, w053.31, w078.7, w078.15, w078.33, w100.A4, and w100.B6.

In one aspect the invention provides a composition comprising nucleic acids encoding HIV-1 envelope w000.T/F (or w004.03), M11, w014.32, w014.12, w030.28, w053.16, w053.31, w078.7, w078.15, w078.33, w100.A4, and w100.B6.

In one aspect the invention provides a composition comprising nucleic acids encoding HIV-1 envelope w000.TF, w004.03, M10, M11, M19, M20, M21, M5, M6, M7, M8, and M9. A composition comprising nucleic acids encoding HIV-1 envelope w000.TF, w004.03, w004.26, M10, M11, M19, M20, M21, M5, M6, M7, M8, and M9. A composition comprising nucleic acids encoding HIV-1 envelope w014.10, w014.2, w014.21, w014.3, w014.32, w014.8, w020.3, w020.4, w020.7, w020.8, w020.9, w020.11, w020.13, w020.14, w020.15, w020.19, w020.22, w020.23, w020.24, and w020.26. A composition comprising nucleic acids encoding HIV-1 envelope w030.5, w030.6, w030.9, w030.10, w030.11, w030.13, w030.15, w030.17, w030.18, w030.19, w030.20, w030.21, w030.23, w030.25, w030.27, w030.28, and w030.36. A composition comprising nucleic acids encoding HIV-1 envelope w053.3, w053.6, w053.13, w053.16, w053.25, w053.29, w053.31, w078.1, w078.6, w078.7, w078.9, w078.10, w078.15, w078.17, w078.25, w078.33, and w078.38. A composition comprising nucleic acids encoding w100.A3, w100.A4, w100.A6, w100.A10, w100.A12, w100.A13, w100.B2, w100.B4, w100.B6, w100.B7, w100.C7, w136.B2, w136.B3, w136.B4, w136.B5, w136.B8, w136.B10, w136.B12, w136.B18, w136.B20, w136.B27, w136.B29, w136.B36, w160.A1, w160.C1, w160.C2, w160.C4, w160.C11, w160.C12, w160.C14, w160.D1, w160.D5, w160.T2, and w160.T4.

In another aspect the invention provides a method of inducing an immune response in a subject comprising administering a composition comprising HIV-1 envelope T/F (or w004.03), and M11 as a prime in an amount sufficient to induce an immune response, wherein the envelope is administered as a polypeptide or a nucleic acid encoding the same. A method of inducing an immune response in a subject comprising administering a composition comprising HIV-1 envelope T/F (or w004.03), M11, w014.32, and w014.12 as a prime in an amount sufficient to induce an immune response, wherein the envelope is administered as a polypeptide or a nucleic acid encoding the same.

In certain embodiments the methods further comprise administering a composition comprising any one of HIV-1 envelope w030.28, w053.16, w053.31, w078.7, w078.15, w078.33, w100.A4, or w100.B6, or any combination thereof as a boost, wherein the envelope is administered as a polypeptide or a nucleic acid encoding the same.

In certain embodiments the methods further comprise administering a composition comprising any one of HIV-1 envelope w014.32, w014.12, w030.28, w053.16, w053.31, w078.7, w078.15, w078.33, w100.A4, or w100.B6, or any combination thereof as a boost, wherein the envelope is administered as a polypeptide or a nucleic acid encoding the same.

In another aspect the invention provides a method of inducing an immune response in a subject comprising administering a composition comprising HIV-1 envelope w000.TF, w004.03, w004.26, M10, M1 1, M19, M20, M21, M5, M6, M7, M8, and M9 as a prime in an amount sufficient to induce an immune response, wherein the envelope is administered as a polypeptide or a nucleic acid encoding the same.

In certain embodiments the methods further comprise administering a composition comprising any one of HIV-1 envelope w014.10, w014.2, w014.21, w014.3, w014.32, w014.8, w020.3, w020.4, w020.7, w020.8, w020.9, w020.11, w020.13, w020.14, w020.15, w020.19, w020.22, w020.23, w020.24, or w020.26, or any combination thereof as a boost, wherein the envelope is administered as a polypeptide or a nucleic acid encoding the same.

In certain embodiments the methods further comprise administering a composition comprising any one of HIV-1 envelope w030.5, w030.6, w030.9, w030.10, w030.11, w030.13, w030.15, w030.17, w030.18, w030.19, w030.20, w030.21, w030.23, w030.25, w030.27, w030.28, or w030.36, or any combination thereof as a boost, wherein the envelope is administered as a polypeptide or a nucleic acid encoding the same.

In certain embodiments the methods further comprise administering a composition comprising any one of HIV-1 envelope w053.3, w053.6, w053.13, w053.16, w053.25, w053.29, w053.31, w078.1, w078.6, w078.7, w078.9, w078.10, w078.15, w078.17, w078.25, w078.33, or w078.38, or any combination thereof as a boost, wherein the envelope is administered as a polypeptide or a nucleic acid encoding the same.

In certain embodiments the methods further comprise administering a composition comprising any one of HIV-1 envelope w100.A3, w100.A4, w100.A6, w100.A10, w100.A12, w100.A13, w100.B2, w100.B4, w100.B6, w100.B7, w100.C7, w136.B2, w136.B3, w136.B4, w136.B5, w136.B8, w136.B10, w136.B12, w136.B18, w136.B20, w136.B27, w136.B29, w136.B36, w160.A1, w160.C1, w160.C2, w160.C4, w160.C11, w160.C12, w160.C14, w160.D1, w160.D5, w160.T2, or w160.T4, or any combination thereof as a boost, wherein the envelope is administered as a polypeptide or a nucleic acid encoding the same.

In certain embodiments, the compositions contemplate nucleic acid, as DNA and/or RNA, or proteins immunogens either alone or in any combination. In certain embodiments, the methods contemplate genetic, as DNA and/or RNA, immunization either alone or in combination with envelope protein(s).

In certain embodiments the nucleic acid encoding an envelope is operably linked to a promoter inserted an expression vector. In certain aspects the compositions comprise a suitable carrier. In certain aspects the compositions comprise a suitable adjuvant.

In certain embodiments the induced immune response includes induction of antibodies, including but not limited to autologous and/or cross-reactive (broadly) neutralizing antibodies against HIV-1 envelope. Various assays that analyze whether an immunogenic composition induces an immune response, and the type of antibodies induced are known in the art and are also described herein.

In certain aspects the invention provides an expression vector comprising any of the nucleic acid sequences of the invention, wherein the nucleic acid is operably linked to a promoter. In certain aspects the invention provides an expression vector comprising a nucleic acid sequence encoding any of the polypeptides of the invention, wherein the nucleic acid is operably linked to a promoter. In certain embodiments, the nucleic acids are codon optimized for expression in a mammalian cell, in vivo or in vitro. In certain aspects the invention provides nucleic acid comprising any one of the nucleic acid sequences of invention. A nucleic acid consisting essentially of any one of the nucleic acid sequences of invention. A nucleic acid consisting of any one of the nucleic acid sequences of invention. In certain embodiments the nucleic acid of invention, is operably linked to a promoter and is inserted in an expression vector. In certain aspects the invention provides an immunogenic composition comprising the expression vector.

In certain aspects the invention provides a composition comprising at least one of the nucleic acid sequences of the invention. In certain aspects the invention provides a composition comprising any one of the nucleic acid sequences of invention. In certain aspects the invention provides a composition comprising at least one nucleic acid sequence encoding any one of the polypeptides of the invention.

In certain aspects the invention provides a composition comprising at least one nucleic acid encoding HIV-1 envelope T/F, w004.03, M11, w030.28, w053.16, w053.31, w078.7, w078.15, w078.33, w100.A4, and w100.B6 or any combination thereof.

In certain aspects the invention provides a composition comprising at least one nucleic acid encoding HIV-1 envelope T/F, w004.03, M11, w014.32, w014.12, w030.28, w053.16, w053.31, w078.7, w078.15, w078.33, w100.A4, and w100.B6, or any combination thereof.

In certain aspects the invention provides a composition comprising at least one nucleic acid encoding HIV-1 envelope w000.TF, w004.03, w004.26, M10, M11, M19, M20, M21, M5, M6, M7, M8, M9, w014.10, w014.2, w014.21, w014.3, w014.32, w014.8, w020.3, w020.4, w020.7, w020.8, w020.9, w020.11, w020.13, w020.14, w020.15, w020.19, w020.22, w020.23, w020.24, w020.26, w030.5, w030.6, w030.9, w030.10, w030.11, w030.13, w030.15, w030.17, w030.18, w030.19, w030.20, w030.21, w030.23, w030.25, w030.27, w030.28, w030.36, w053.3, w053.6, w053.13, w053.16, w053.25, w053.29, w053.31, w078.1, w078.6, w078.7, w078.9, w078.10, w078.15, w078.17, w078.25, w078.33, w078.38, w100.A3, w100.A4, w100.A6, w100.A10, w100.A12, w100.A13, w100.B2, w100.B4, w100.B6, w100.B7, w100.C7, w136.B2, w136.B3, w136.B4, w136.B5, w136.B8, w136.B10, w136.B12, w136.B18, w136.B20, w136.B27, w136.B29, w136.B36, w160.A1, w160.C1, w160.C2, w160.C4, w160.C11, w160.C12, w160.C14, w160.D1, w160.D5, w160.T2, and w160.T4, or any combination thereof.

In certain embodiments, the compositions and methods employ an HIV-1 envelope as polypeptide instead of a nucleic acid sequence encoding the HIV-1 envelope. In certain embodiments, the compositions and methods employ an HIV-1 envelope as polypeptide, a nucleic acid sequence encoding the HIV-1 envelope, or a combination thereof The envelope used in the compositions and methods of the invention can be a gp160, gp150, gp145, gp140, gp120, gp41, N-terminal deletion variants as described herein, cleavage resistant variants as described herein, or codon optimized sequences thereof.

The polypeptide contemplated by the invention can be a polypeptide comprising any one of the polypeptides described herein. The polypeptide contemplated by the invention can be a polypeptide consisting essentially of any one of the polypeptides described herein. The polypeptide contemplated by the invention can be a polypeptide consisting of any one of the polypeptides described herein. In certain embodiments, the polypeptide is recombinantly produced. In certain embodiments, the polypeptides and nucleic acids of the invention are suitable for use as an immunogen, for example to be administered in a human subject.

BRIEF DESCRIPTION OF THE DRAWINGS

FIGS. 1A-C show CH505 Env polymorphisms, neutralization, vaccine regimes, and phylogeny.

FIG. 3 shows one embodiment of alignment columns in Env "hot-spot" summaries, concatenated to comprise concatamers.

FIG. 4 shows another embodiment of alignment columns in Env "hot-spot" concatamer summaries.

FIG. 5 shows one embodiment of selected Envs as concatenated sites.

FIG. 6 shows another embodiment of selected Envs as concatenated sites.

FIG. 7 shows one embodiment of a proposed swarm of CH505 envelopes.

FIG. 8 shows another embodiment of a proposed swarm of CH505 envelopes.

FIGS. 13A-C show an enlarged version of FIGS. 1A-C. FIGS. 1A-C show the genotype variation (A, left panel), neutralization titers (B, center panel), and Envelope phylogenetic relations (C, right panel) among CH505 Envelope variants. The vertical position in each panel corresponds to the same CH505 Env clone named on the right side of the tree. Distance from the Transmitted/Founder form generally increases from top towards bottom of the figure. In the left panel (A), sites not colored correspond to the Transmitted/Founder virus, red sites show mutations, and black sites correspond to insertions or deletions relative to the Transmitted/Founder virus. Additional annotation indicates the known CD4 binding-site contacts (short, vertical black bars towards top), CH103 binding-site contacts for the resolved structure (short, vertical blue bars with a horizontal line to indicate the region resolved by X-Ray Crystallography), gp120 landmarks (vertical grey rectangular regions, V1-V5 hypervariable loops, Loop D, and CD4 Loops), a dashed vertical line delineating the gp120/gp41 boundary, and results from testing for CTL epitopes with ELISpot assays (magenta bands at top and bottom show where peptides were tested and negative, and a magenta rectangle for the tested positive region outside the C-terminal end of V4). The center panel (B) depicts IC50 (50% inhibitory concentrations, in µg/ml) values from autologous neutralization assays against 13 monoclonal antibodies (MAbs) of the CH103 lineage and each of 134 CH505 Env-pseudotyped viruses. Color-scale values indicate neutralization potency and range from grey (no neutralization detected) through dark red (potent neutralization, i.e. <0.2 µg/ml; empty cells correspond to absence of information). The cumulative progression of neutralization potency from left to right, corresponding to developmental stages in the CH103 lineage, indicates accumulation of neutralization potency. Similarly, increased presence neutralization signal from top to bottom corresponds to increasing neutralization breadth per MAb in the CH103 lineage. In the right-most panel (C) is the phylogeny of CH505 Envs, with the x-axis indicating distance from the Transmitted-Founder virus per the scale bar (units are mutations per site). The tree is ordered vertically such that lineages with the most descendants appear towards the bottom. Each leaf on the tree corresponds to a CH505 autologous Env, with the name of the sequence depicted ('w' and symbol color indicate the sample time-point; 'M'i ndicates a synthetic mutant Env). The color of text in each leaf name indicates its inclusion in a possible embodiment, or grey for exclusion from any embodiments described herein. Three long, vertical lines to the left of the tree depict the phylogenetic distribution of envelopes in three distinct alternative embodiments (identified as "Vaccination Regimes 1-3"), with diamonds used to identify each.

FIG. 14A shows nucleic acid sequence of T/F virus from individual CH505 (SEQ ID NO: 1)FIG. 14B shows CH505 HIV-1 gene sequences (SEQ ID NOS 2-10, respectively, in order of appearance).

FIG. 15 shows nucleic acid sequences (gp160) of CH505 envelopes (SEQ ID NOS 11-112, respectively, in order of appearance).

FIG. 16 shows nucleic acid sequences encoding gp120D CH505 envelopes (SEQ ID NOS 113-215, respectively, in order of appearance).

FIG. 17 shows amino acid sequences (gp160) of CH505envelopes (SEQ ID NOS 216-321, respectively, in order of appearance). "Z" at the end of the sequence indicates a stop codon.

FIG. 18 shows amino acid sequences (gp120D8) of CH505 envelopes (SEQ ID NOS 322-424, respectively, in order of appearance).

FIG. 19A shows one embodiment of a swarm of CH505 envelopes (SEQ ID NOS 425-437, respectively, in order of appearance). FIG. 19B shows the complete sequences of the envelopes of FIG. 19A (SEQ ID NOS 425-437, respectively, in order of appearance). FIG. 19C shows one embodiment of a swarm of CH505 envelopes (SEQ ID NOS 438-449, respectively, in order of appearance).

FIG. 20 shows amino acid sequences (gp145) of CH505 envelopes (SEQ ID NOS 450-553, respectively, in order of appearance).

FIG. 21 shows nucleic acid sequences encoding gp145 CH505 envelopes (SEQ ID NOS 554-657, respectively, in order of appearance).

FIG. 26 shows FACS analysis identifying CH505 TF gp120 Reactive Memory B Cells that Demonstrate RSC3 Binding Reactivity (Gr. 1, animal 5346 in NHP study #79). FACS analysis is carried out essentially as described in Example 1.

FIG. 28 shows induction of autologous neutralization of both the transmitted/founder CH505 Env and neutralization sensitive CH505 Env variant w004.3 in NHPs. Shown is week 14 neutralization data from TZMb1 assay after three immunizations.

FIG. 31 shows sequences of trivalent envelope mosaics (SEQ ID NOS 658-663, respectively, in order of appearance).

DETAILED DESCRIPTION OF THE INVENTION

Figure 1A:
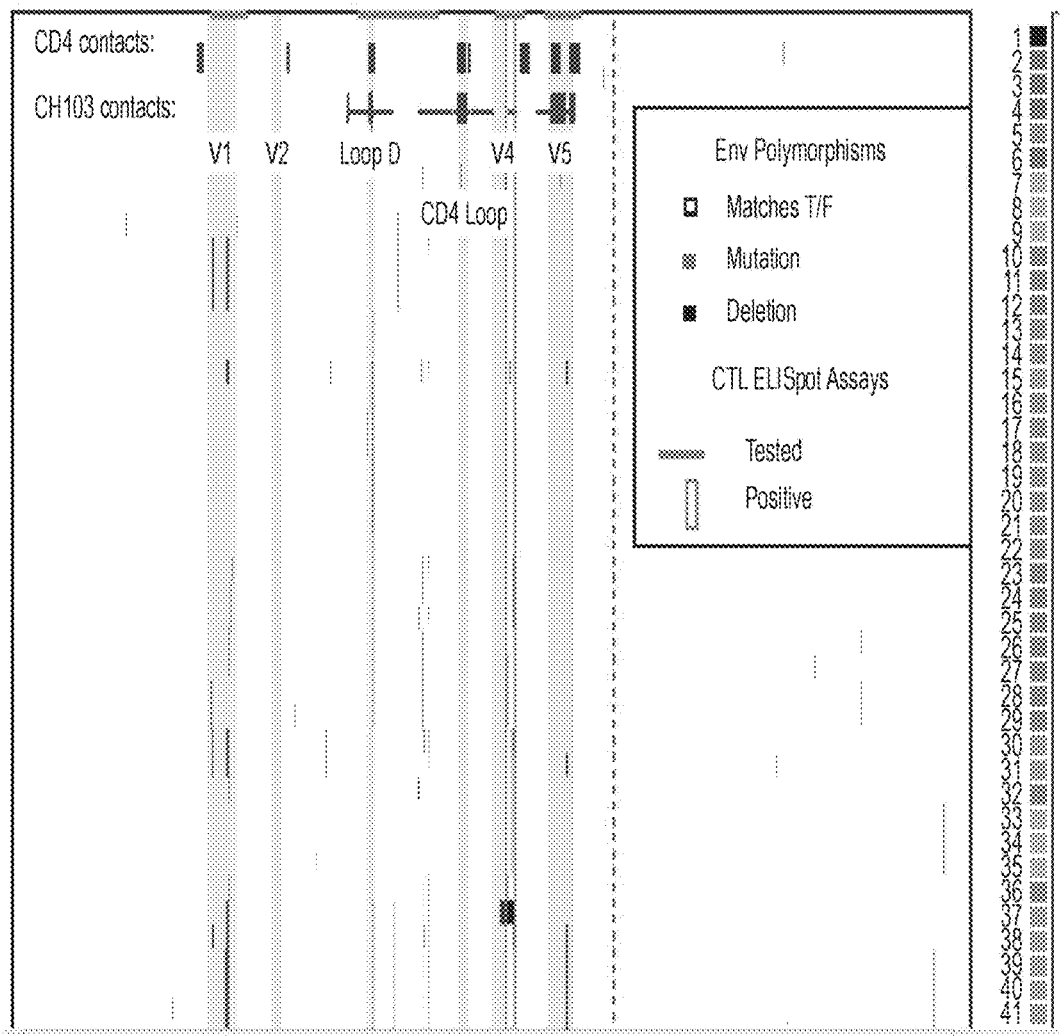
Figure 1A:
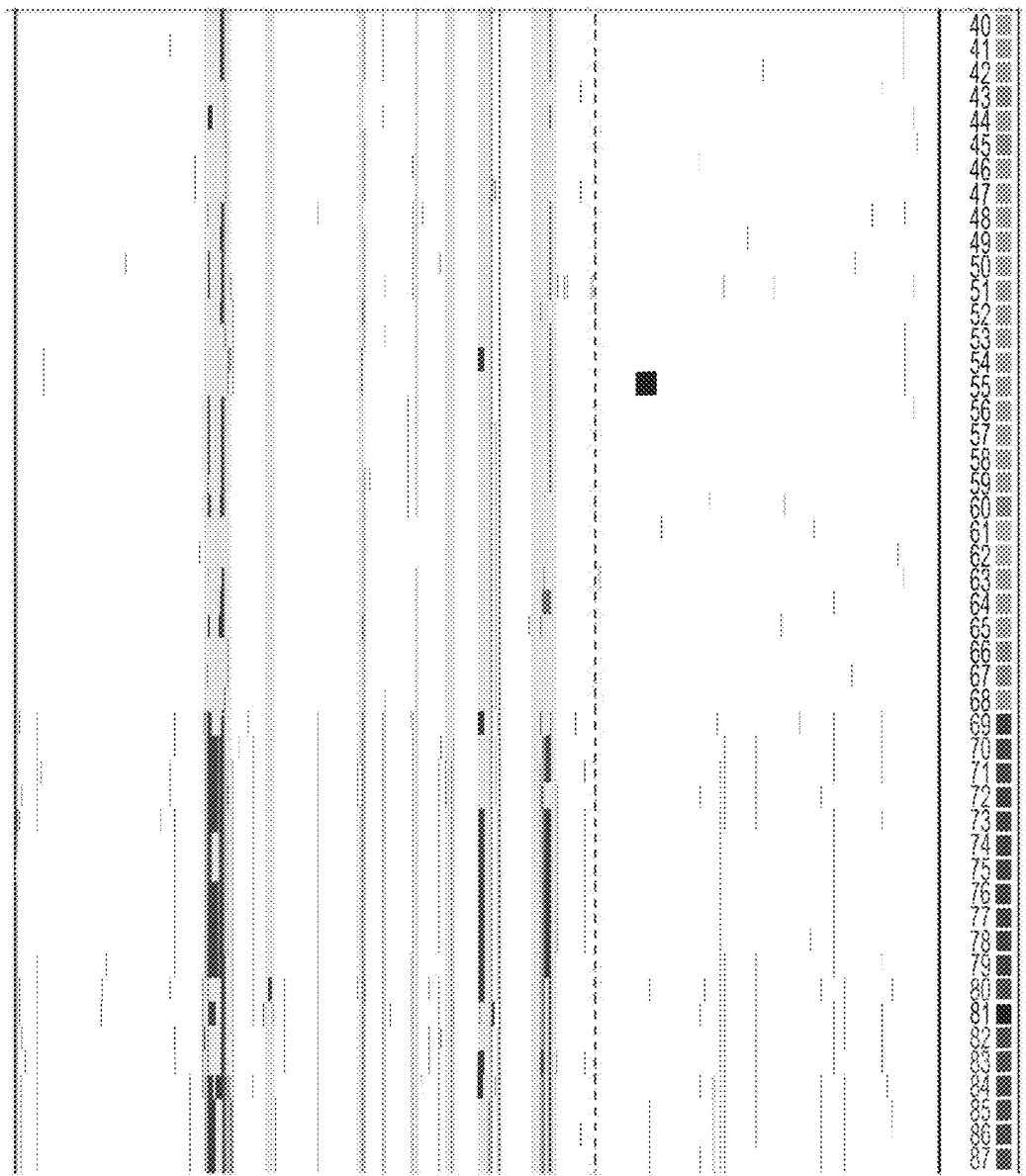
Figure 1A:
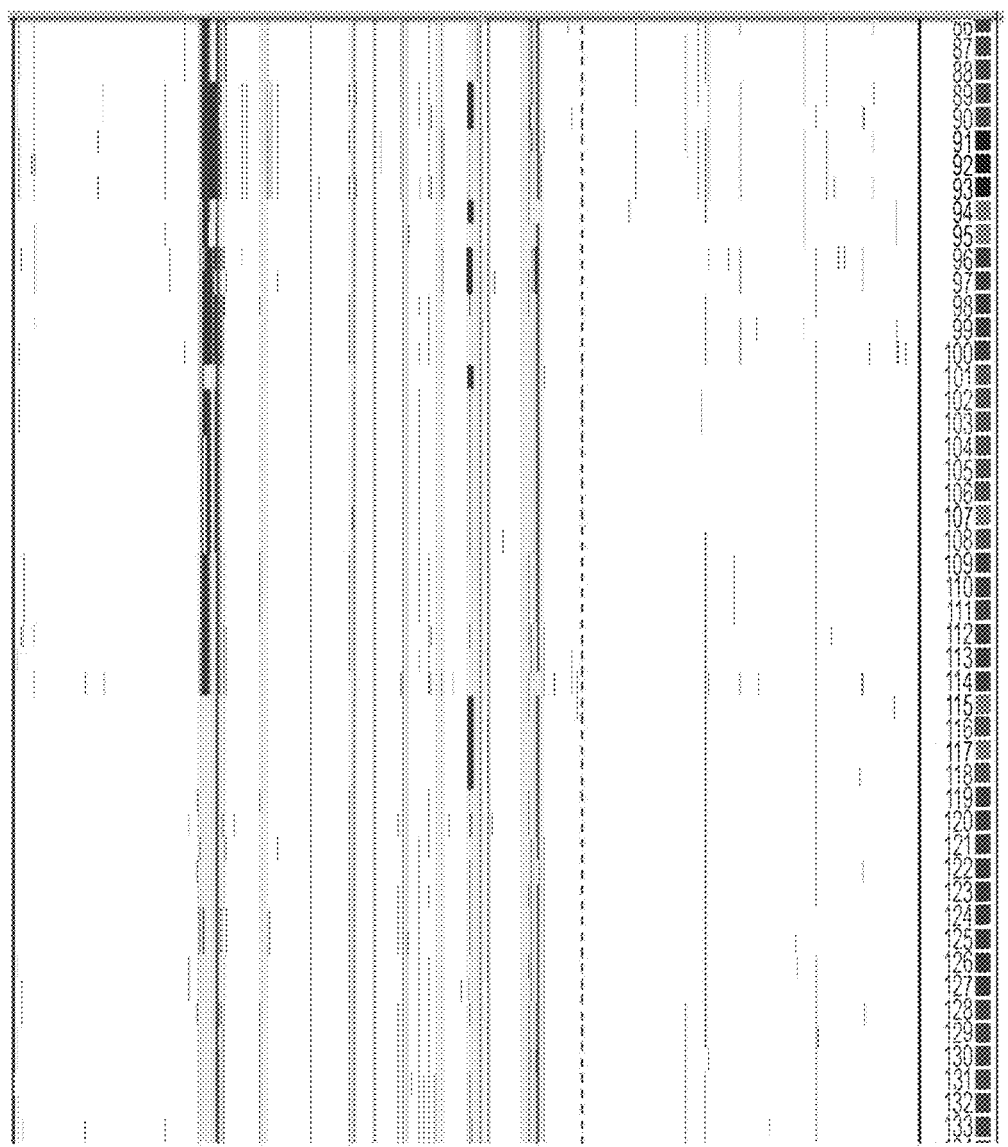
Figure 1A:
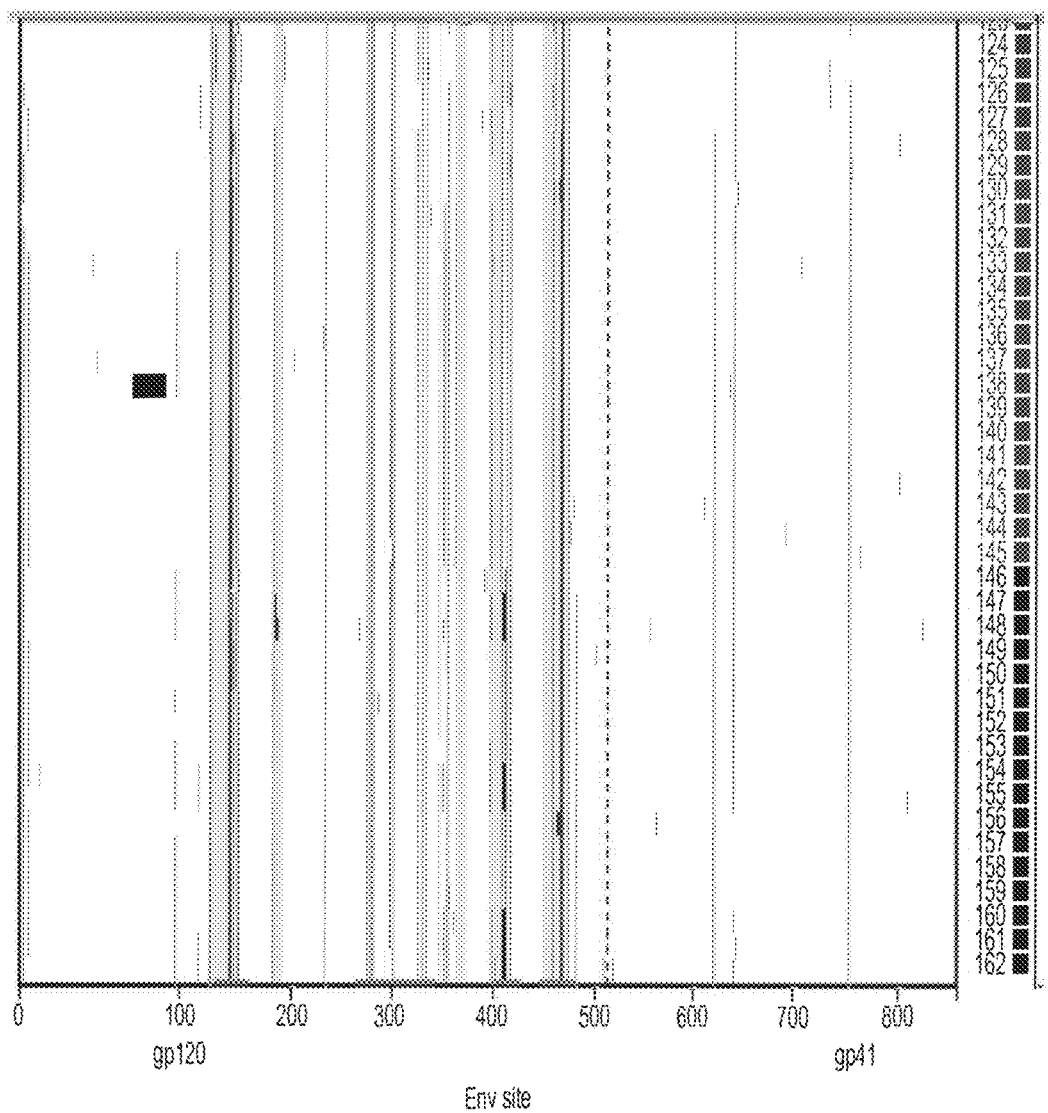
Figure 2:
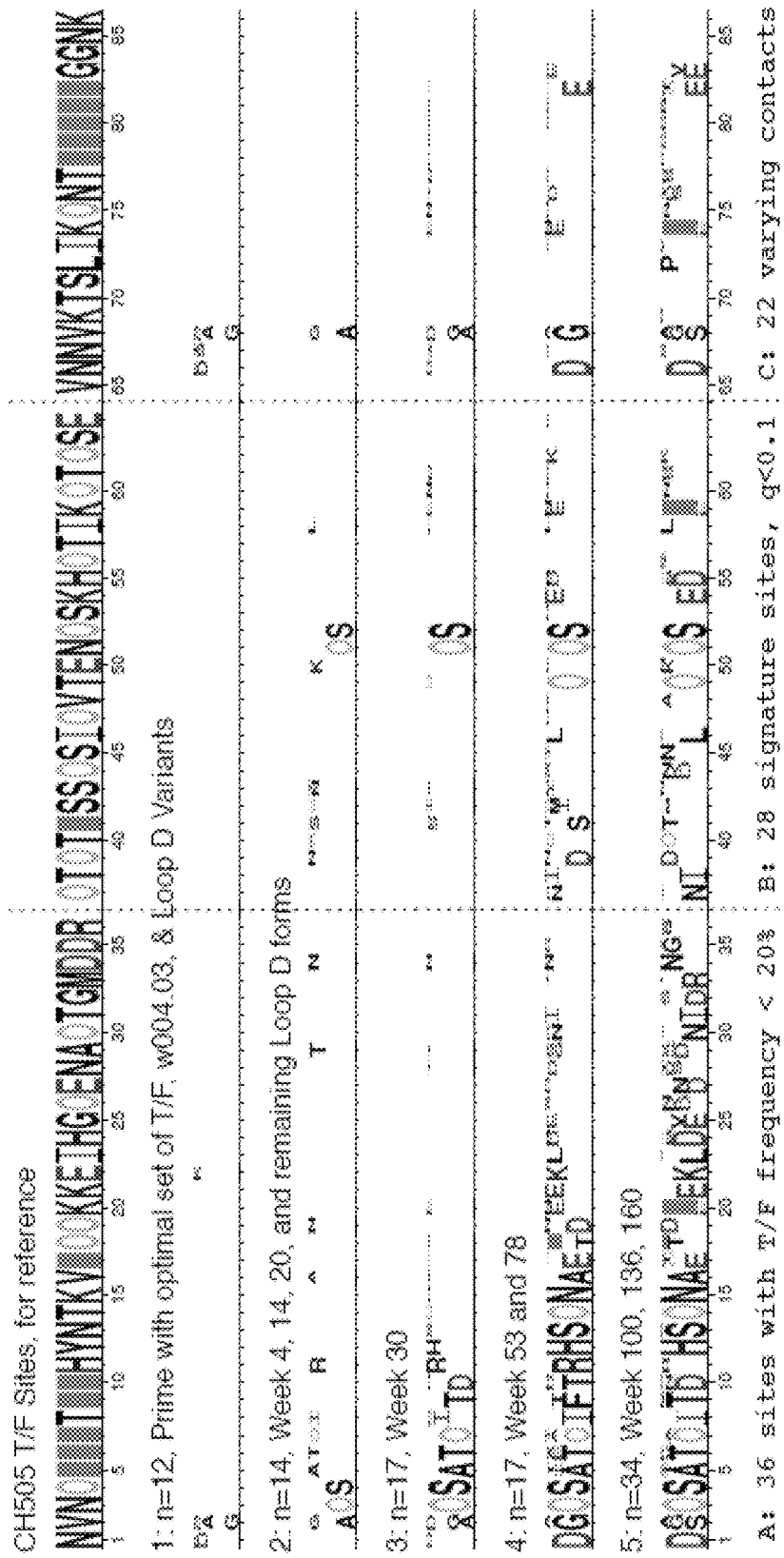
FIG. 2 shows swarm vaccine variant frequencies in concatenated Env "hot-spot" sites, numbered as in Table 1. These sites were used to identify immunogens because they include polymorphisms resulting from immune selection by neutralizing antibodies. Three criteria identified Env sites of outstanding interest ("hot spots") for antibody evolution: (a) "selected" sites with T/F frequency below 20% in any time-point sampled, (b) single or PNG sites with q<0.1 for tree-corrected signatures of neutralization activity, and (c) CD4 binding-site and known CH103 contacts with any variation. We extracted these sites from aligned sequences and concatenated them to see how each candidate clone varies in Env "hot spots" (Table 1). Rather than eliminate sites found by multiple methods, duplicate sites are included multiple times, for emphasis.
Figure 9:
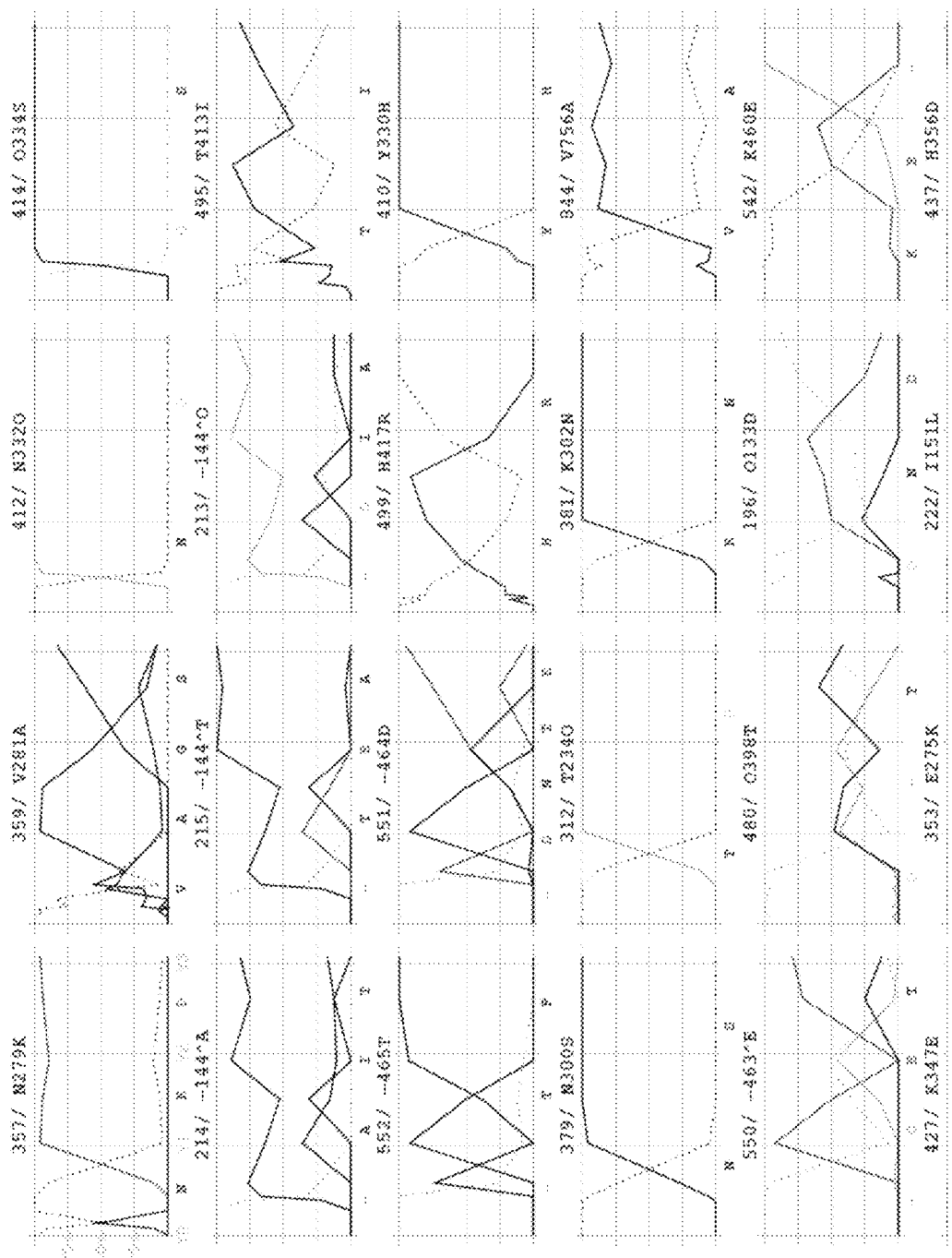
FIG. 9 shows temporal development of CH505 variant frequencies for 36 Env sites from time of infection (Y0) through three years of follow-up (Y3), resulting from development of neutralizing antibody responses with increasing heterologous neutralization breadth. An O indicates a potentially N-(asparagine) linked glycosylation site. For clarity, only variants that exceed 20% frequency in any given sample are shown.
Figure 9:
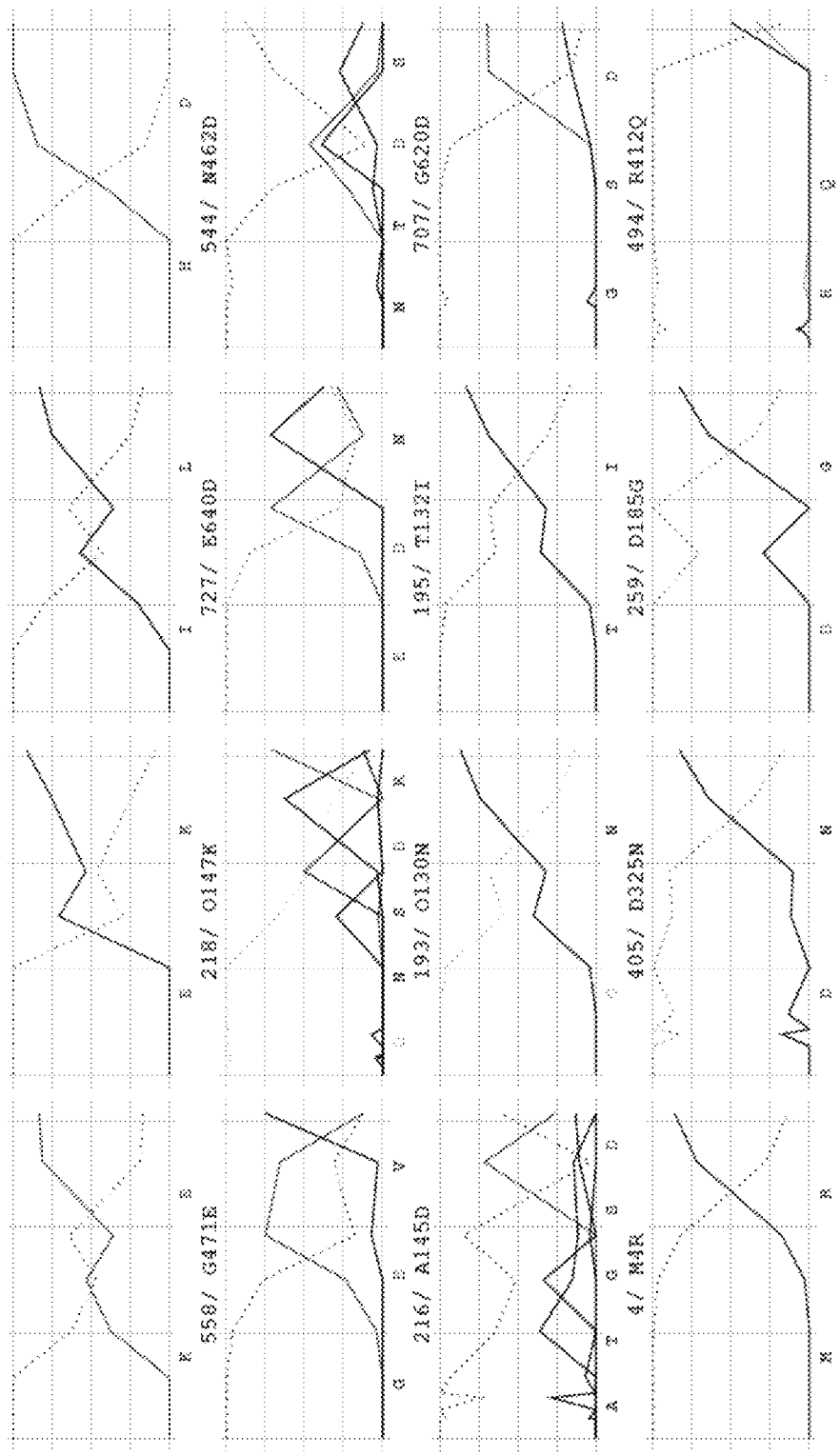
Figure 10:
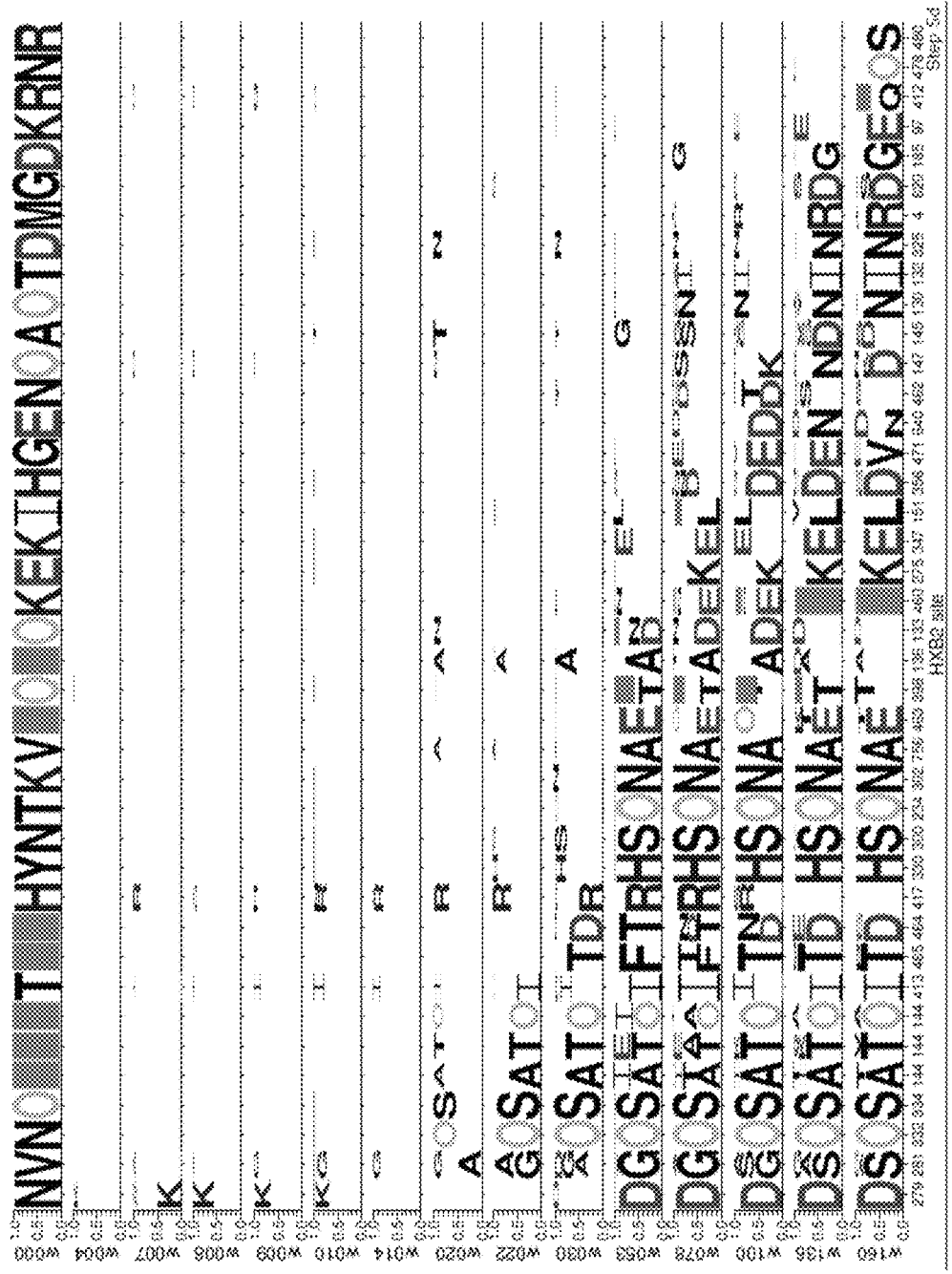
FIG. 10 shows temporal progression of CH505 variant frequencies for 40 Env sites from time of infection with the Transmitted/Founder virus (w000) through three years of follow-up (w160). Height of each character indicates its frequency per sample. In all except the top row, the Transmitted/Founder virus is not shown and constitutes the remaining portion of the sample. Insertions or deletions (indels) appear as grey blocks. Multiple sites with the same HXB2 numbering correspond to un-numbered insertions towards the C-terminal end of the position numbered.
Figure 11:
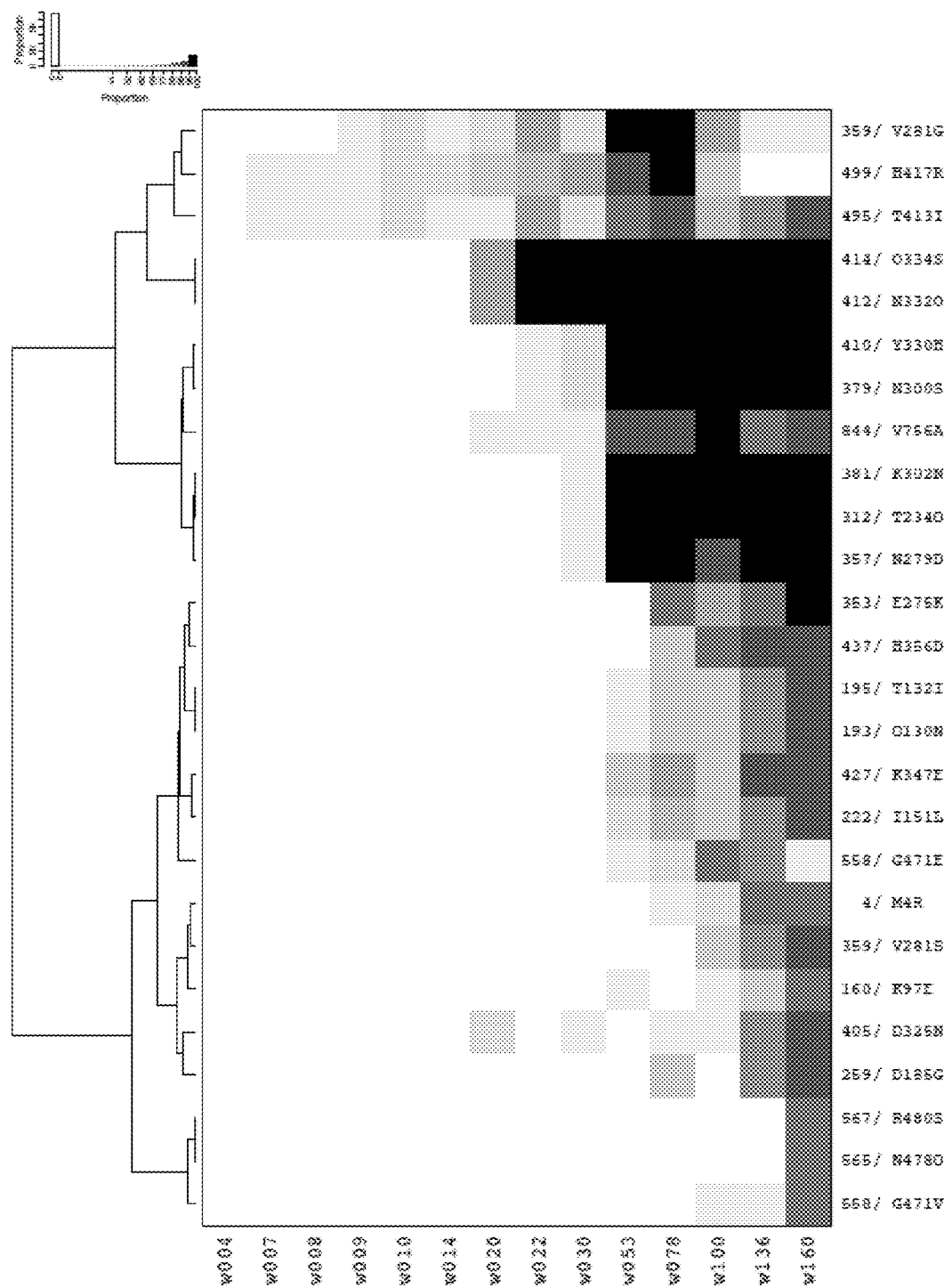
FIG. 11 shows hierarchical clustering of CH505 variant frequencies per longitudinal sample (x-axis) for 26 selected CH505 Env mutations. Frequency of non-Transmitted/Founder mutations is proportional to the grey-scale value in each cell, and cells clustered together on the vertical axis indicate Env sites that vary in a concerted manner (i.e. in the same temporal window), rather than independently. Where a numbered site appears more than once (e.g., 359/V281G and 359/ V281 S), it depicts alternative non-Transmitted/Founder variant forms. Sites with indels and variant forms that fail to exceed 25% frequency of any given sample were excluded for clarity.
Figure 12:
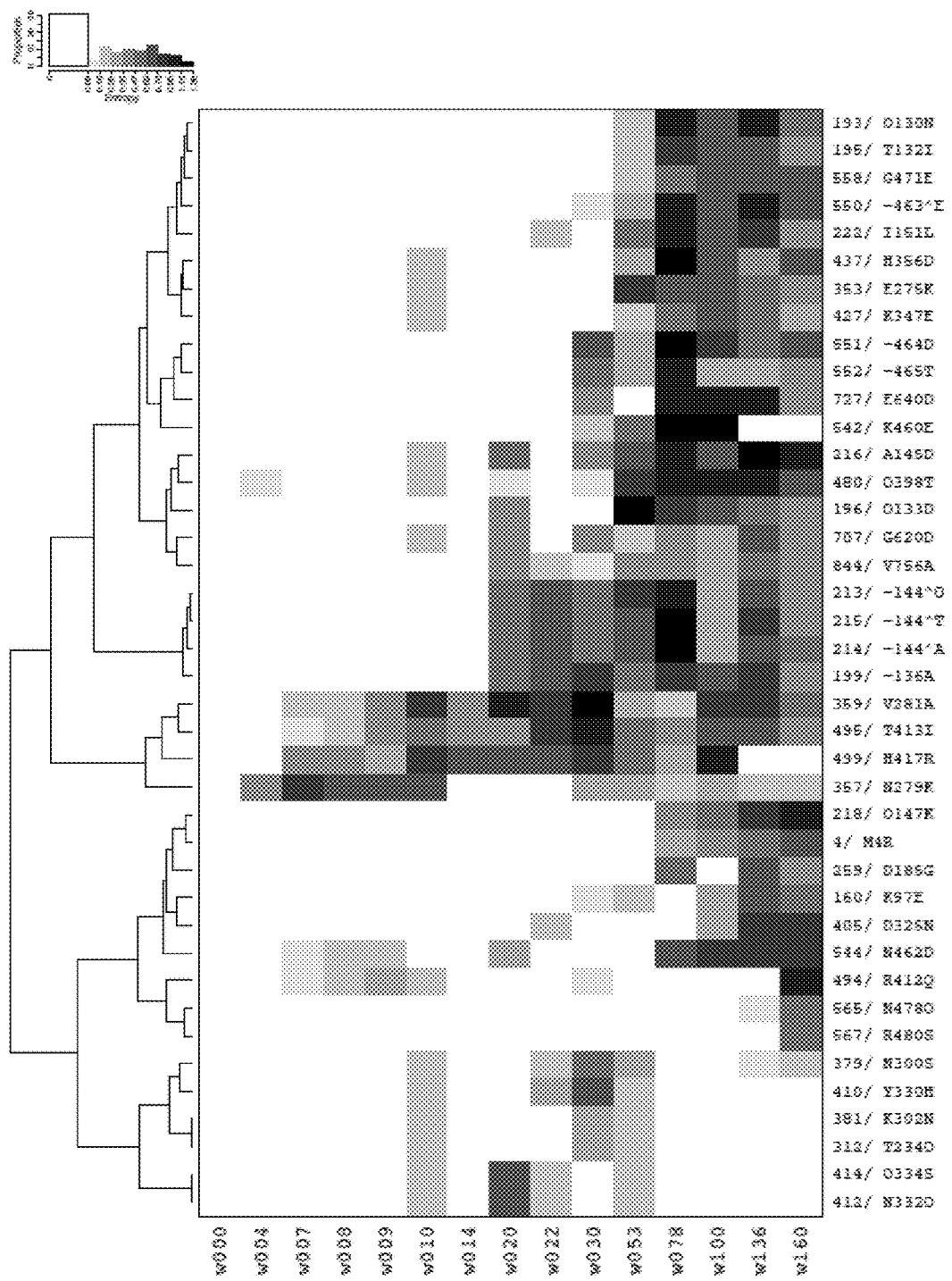
FIG. 12 shows hierarchical clustering of Shannon entropies per longitudinal sample (x-axis) for 40 selected CH505 Env sites. Low entropy means high prevalence of a single variant, whether Transmitted/Founder or an escape mutation, and high entropy indicates high variability. This uses the same information as FIGS. 9-11 but shows when and where variation is most active, clustering together on the vertical axis sites that share variability (entropy) profiles.
Figure 13A:
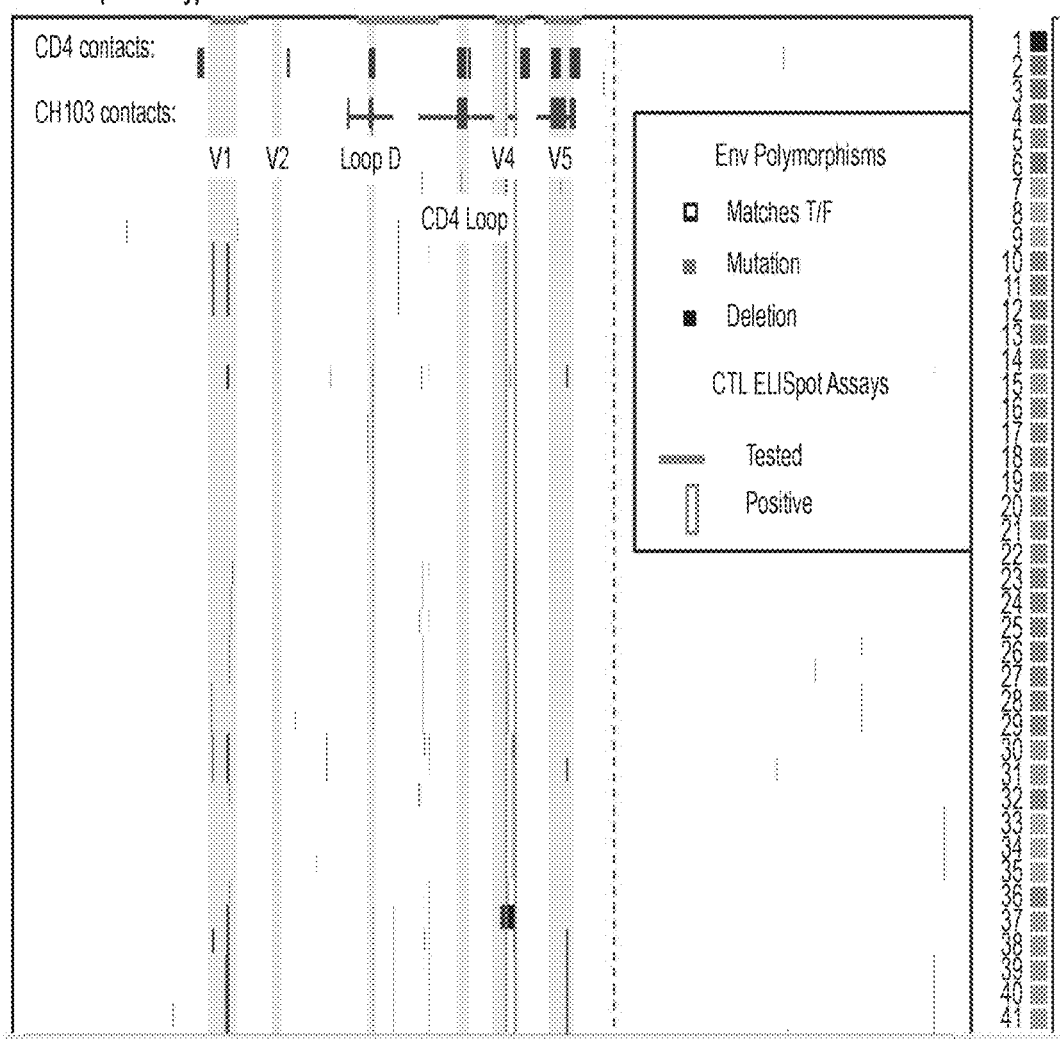
Figure 13A:
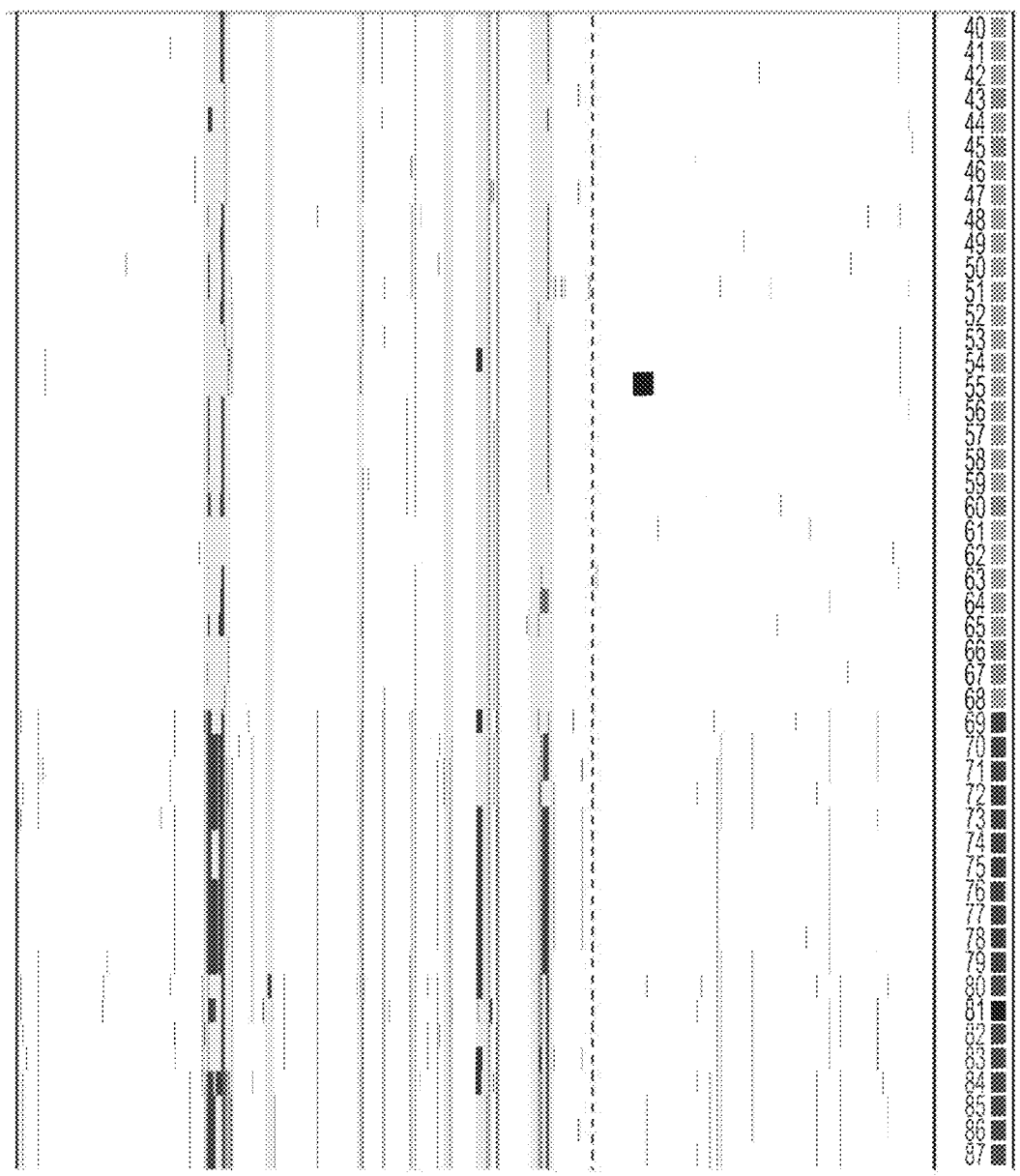
Figure 13A:
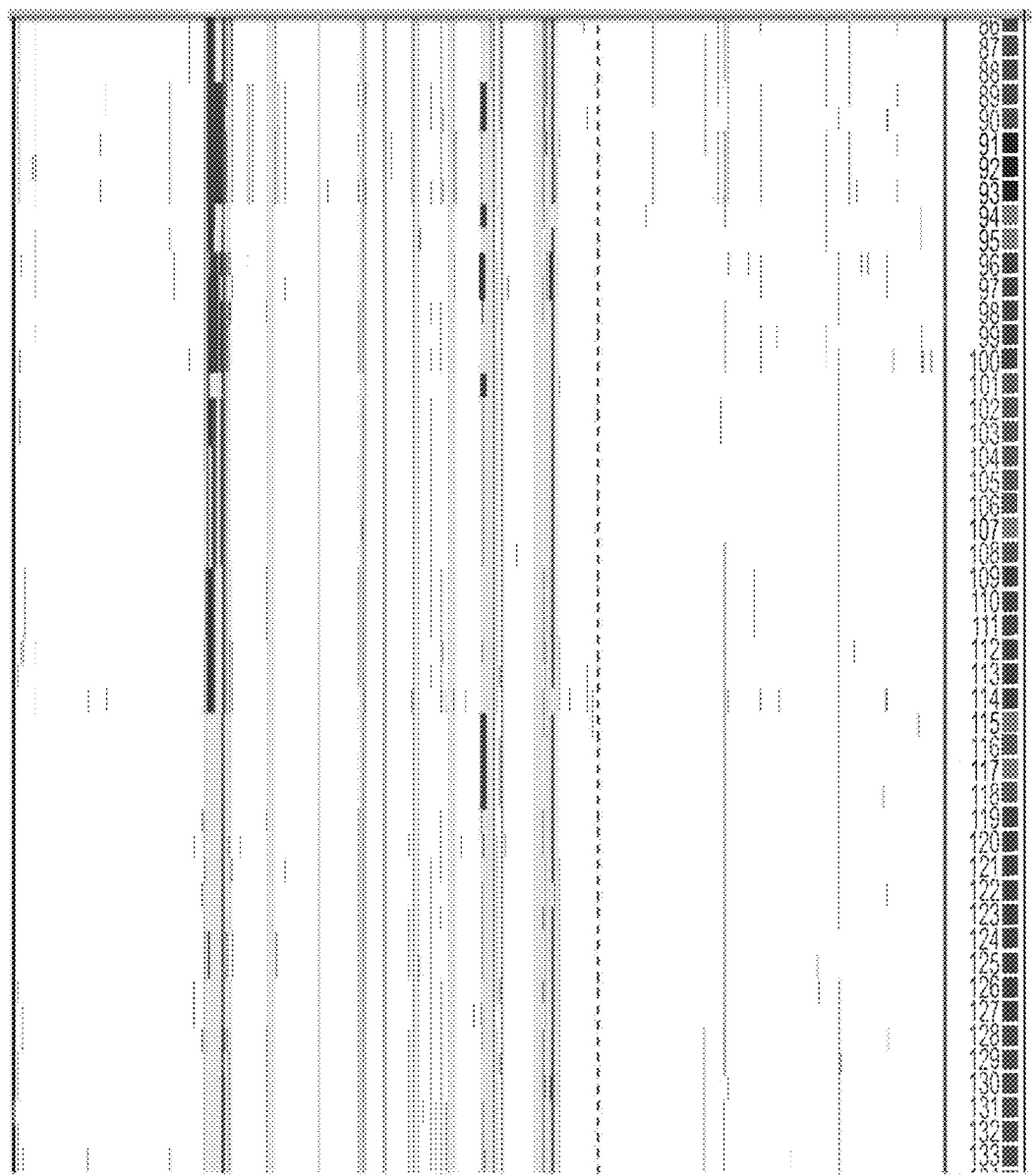
Figure 13A:
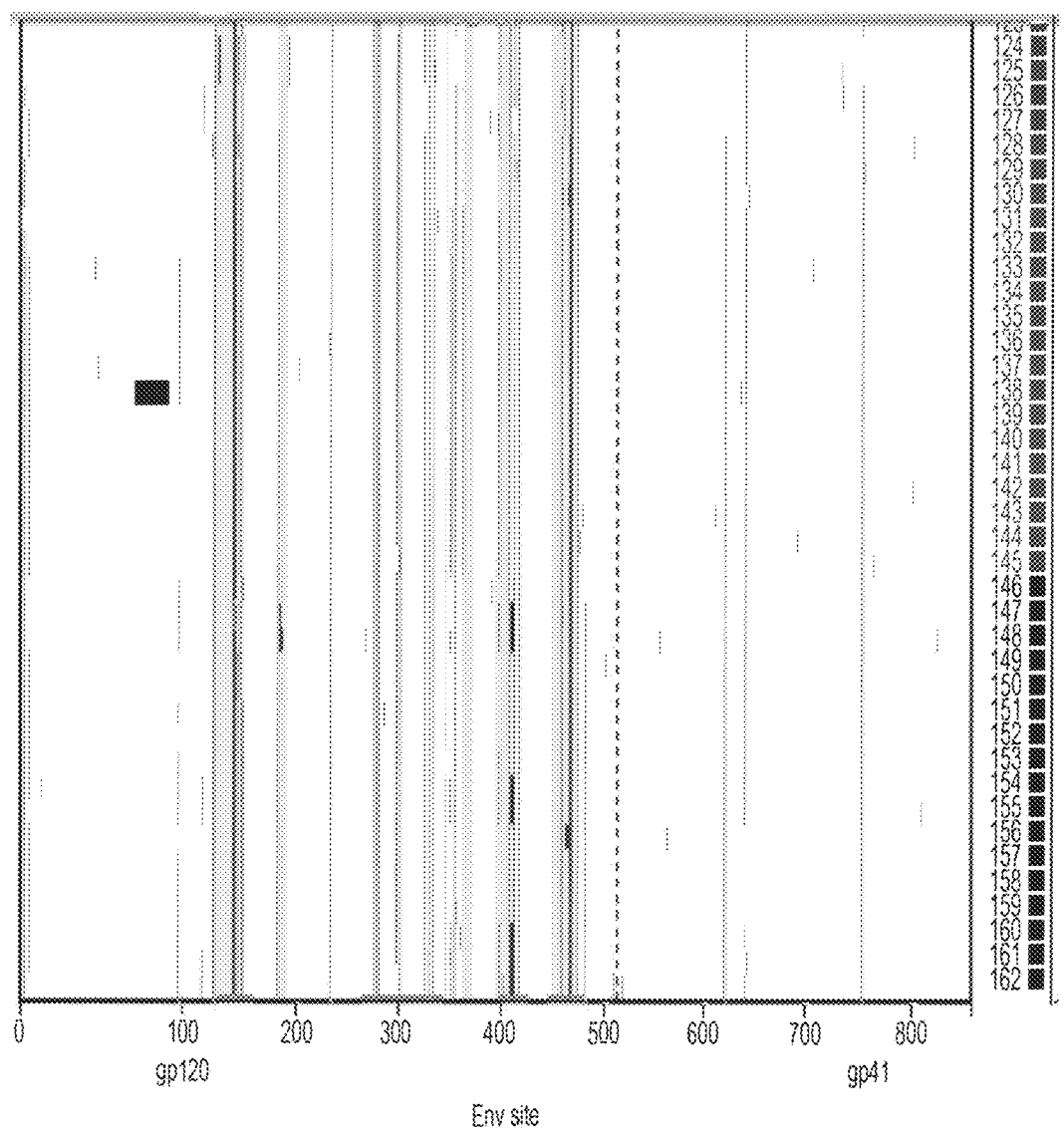

The development of a safe, highly efficacious prophylactic HIV-1 vaccine is of paramount importance for the control and prevention of HIV-1 infection. A major goal of HIV-1 vaccine development is the induction of broadly neutralizing antibodies (bnAbs) (Immunol. Rev. 254: 225-244, 2013). BnAbs are protective in rhesus macaques against SHIV challenge, but as yet, are not induced by current vaccines.

For the past 25 years, the HIV vaccine development field has used single or prime boost heterologous Envs as immunogens, but to date has not found a regimen to induce high levels of bnAbs.

Recently, a new paradigm for design of strategies for induction of broadly neutralizing antibodies was introduced, that of B cell lineage immunogen design (Nature Biotech. 30: 423, 2012) in which the induction of bnAb lineages is recreated. It was recently demonstrated the power of mapping the co-evolution of bnAbs and founder virus for elucidating the Env evolution pathways that lead to bnAb induction (Nature 496: 469, 2013). From this type of work has come the hypothesis that bnAb induction will require a selection of antigens to recreate the "swarms" of sequentially evolved viruses that occur in the setting of bnAb generation in vivo in HIV infection (Nature 496: 469, 2013).

A critical question is why the CH505 immunogens are better than other immunogens. This rationale comes from three recent observations. First, a series of immunizations of single putatively "optimized" or "native" trimers when used as an immunogen have not induced bnAbs as single immunogens. Second, in all the chronically infected individuals who do develop bnAbs, they develop them in plasma after ~2 years. When these individuals have been studied at the time soon after transmission, they do not make bnAbs immediately. Third, now that individual's virus and bnAb co-evolution has been mapped from the time of transmission to the development of bnAbs, the identification of the specific Envs that lead to bnAb development have been identified-thus taking the guess work out of env choice.

Two other considerations are important. The first is that for the CH103 bnAb CD4 binding site lineage, the VH4-59 and Vλ3-1 genes are common as are the VDJ, VJ recombinations of the lineage (Liao, Nature 496: 469, 2013). In addition, the bnAb sites are so unusual, we are finding that the same VH and VL usage is recurring in multiple individuals. Thus, we can expect the CH505 Envs to induce CD4 binding site antibodies in many different individuals.

Finally, regarding the choice of gp120 vs. gp160, for the genetic immunization we would normally not even consider not using gp160. However, in acute infection, gp41 non-neutralizing antibodies are dominant and overwhelm gp120 responses (Tomaras, G et al. J. Virol. 82: 12449, 2008; Liao, H X et al. JEM 208: 2237, 2011). Recently we have found that the HVTN 505 DNA prime, rAd5 vaccine trial that utilized gp140 as an immunogen, also had the dominant response of non-neutralizing gp41 antibodies. Thus, we will evaluate early on the use of gp160 vs gp120 for gp41 dominance.

In certain aspects the invention provides a strategy for induction of bnAbs is to select and develop immunogens designed to recreate the antigenic evolution of Envs that occur when bnAbs do develop in the context of infection. Therefore, we believe that the groups of CH505 Envs proposed in this study is the "best in class" of current Env immunogens.

Figure 22:
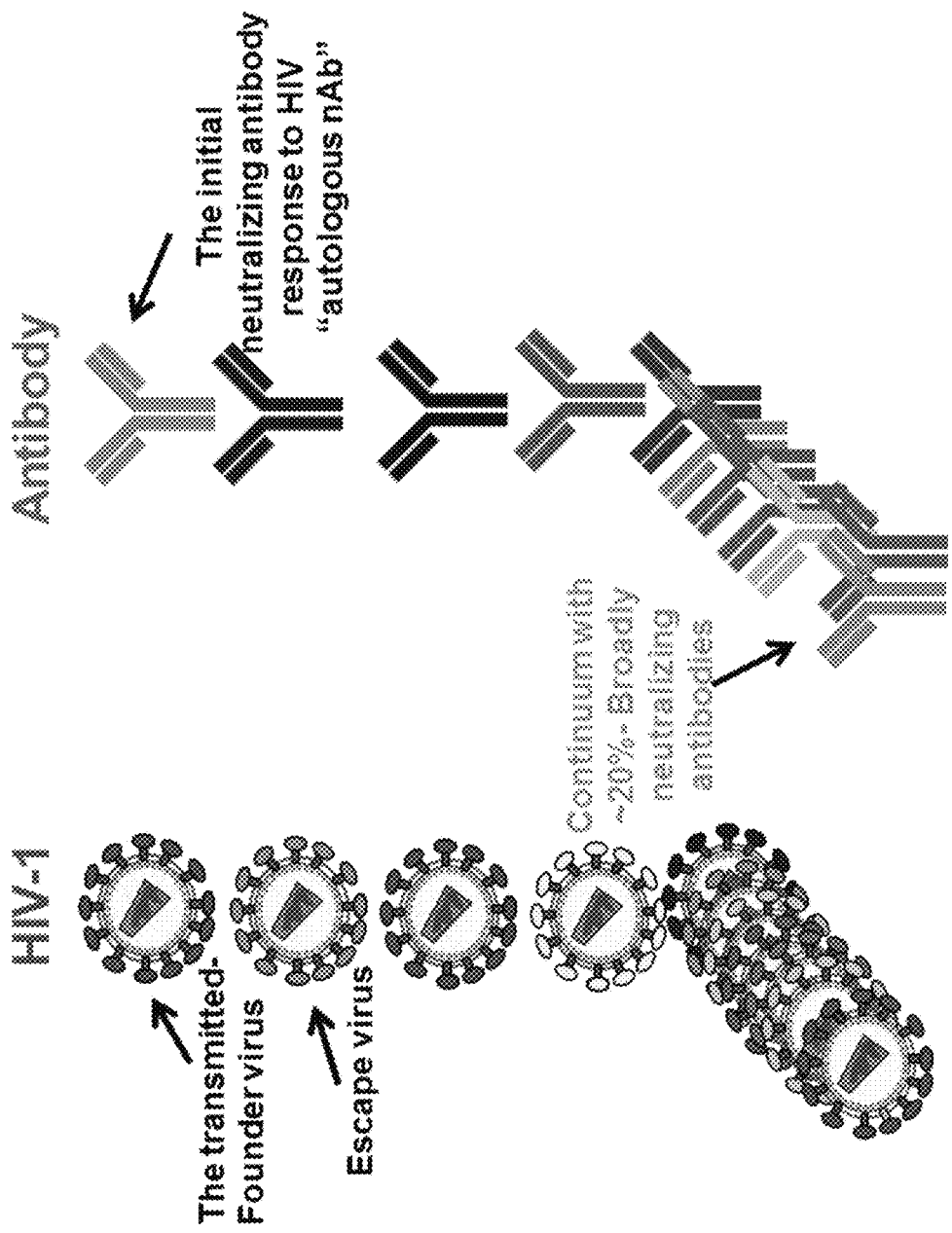
FIG. 22 shows "The HIV-1 Arms Race" as a graphical representation of mapping the Virus and Antibody from the Time of Transmission.
Figure 23:
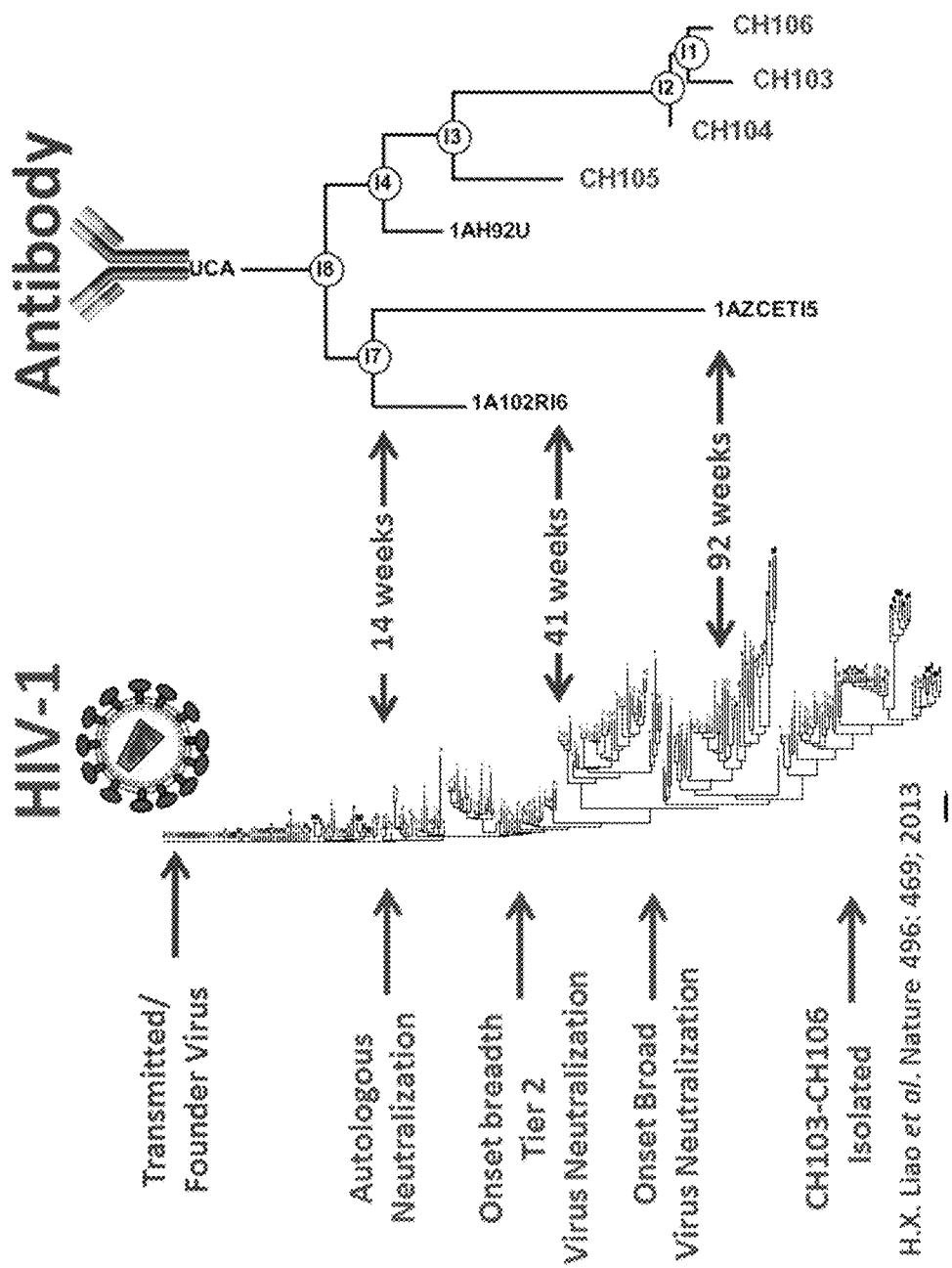
FIG. 23*shows* isolation of broad neutralizing antibodies from chronically Infected Individual CH0505 Followed From Time of Transmission
Figure 24:
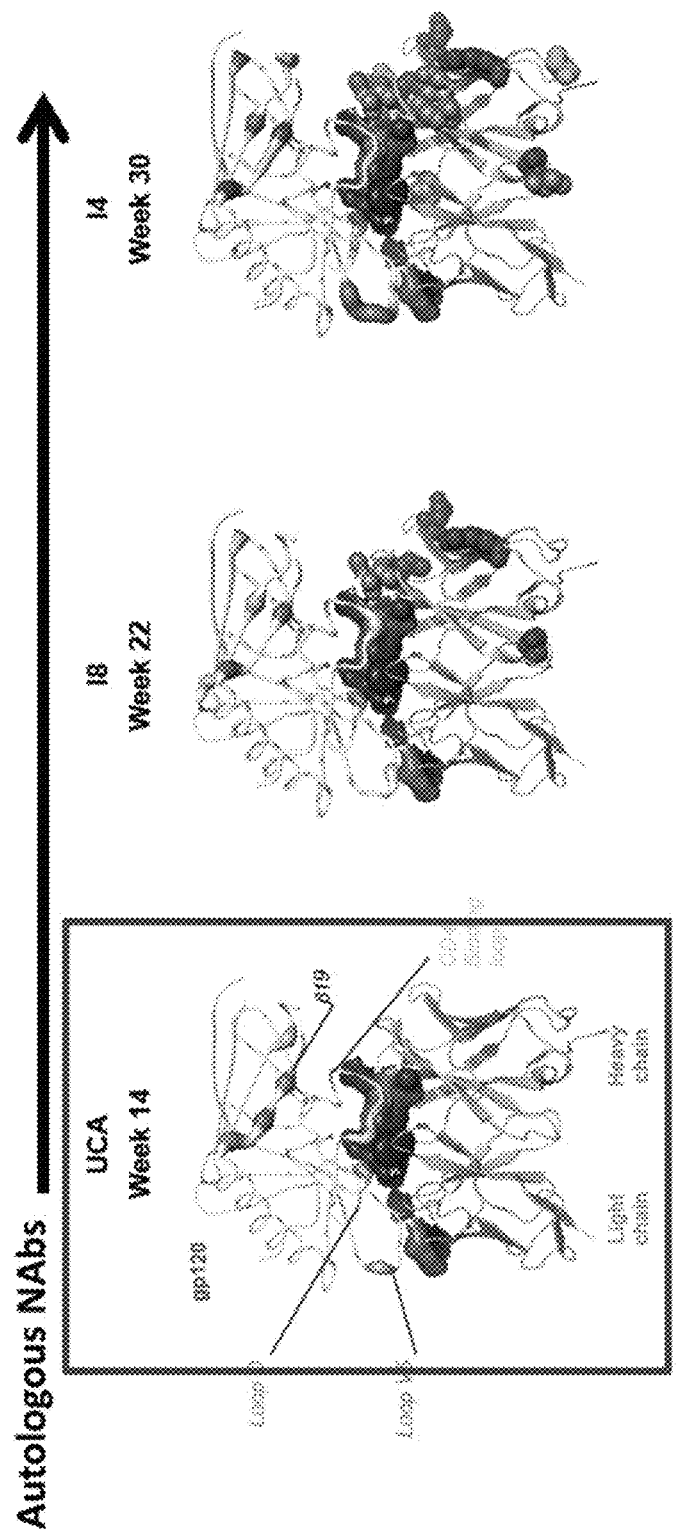
FIG. 24 shows tempo and site of accumulation of mutations at the contact sites between virus and CH103 mAb.
Figure 24:
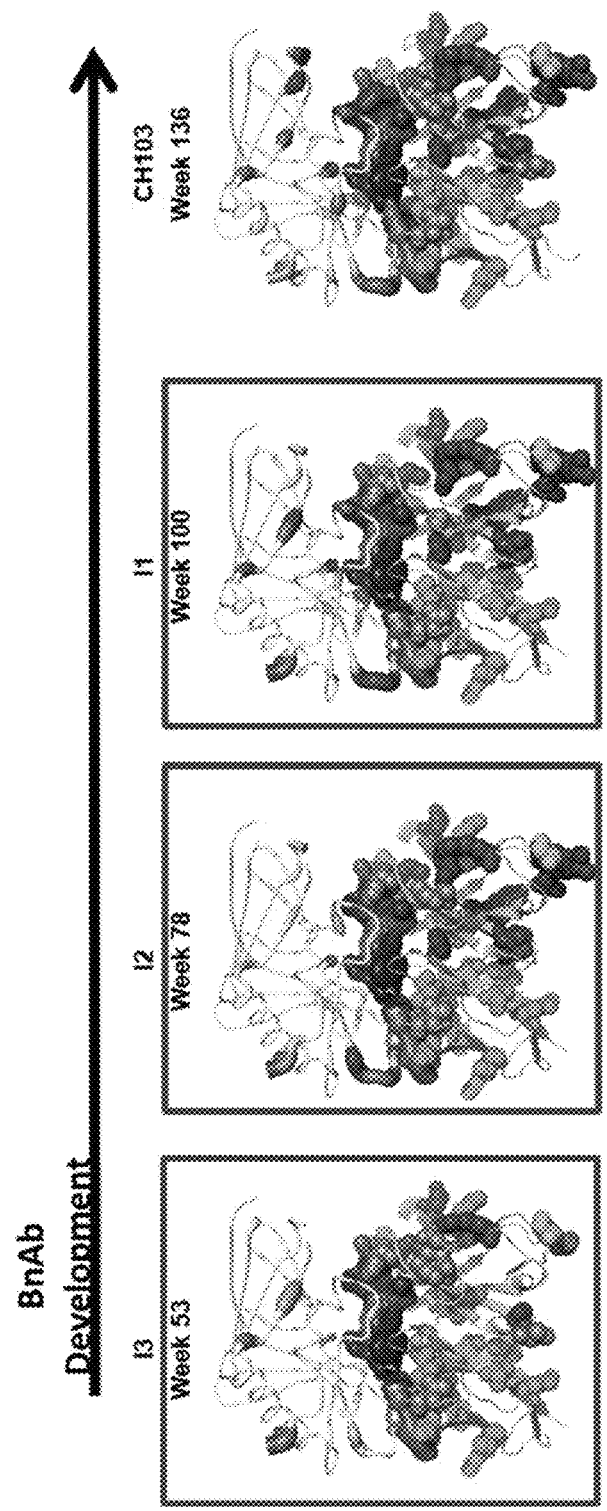
Figure 25:
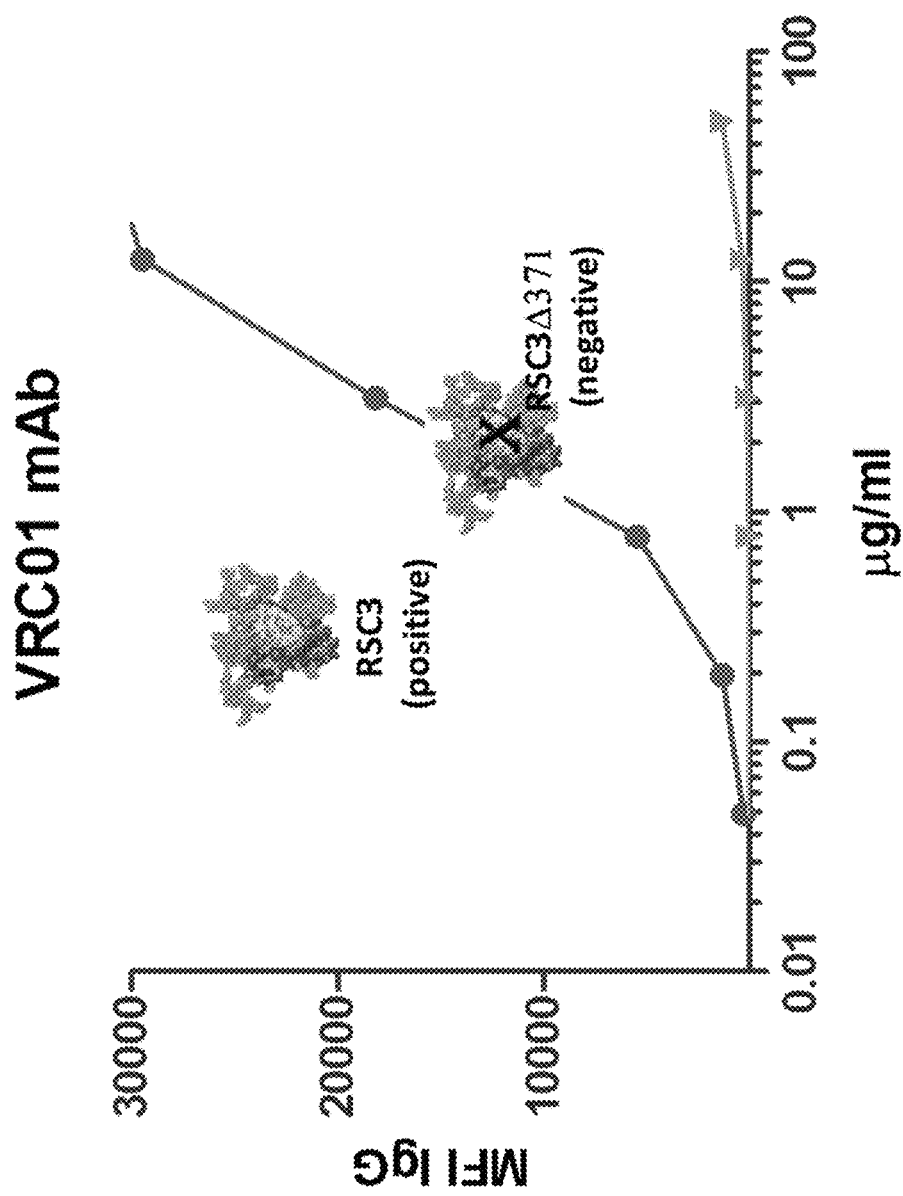
FIG. 25 shows an assay for identification of CD4 Binding Site broad neutralizing lineage antibodies. VRC01 and CH103 CD4Binding Site BnAbs do not bind RSCdelta371 (D371). For plasma, a greater than 2.5 fold loss of binding when the titer is over 200 suggests the presence of CD4bs BnAb (Lynch, JVI, 2012).

That broadly neutralizing antibodies (bnAbs) occur in nearly all sera from chronically infected HIV-1 subjects suggests anyone can develop some bnAb response if exposed to immunogens via vaccination. Working back from mature bnAbs through intermediates enabled understanding their development from the unmutated ancestor, and showed that antigenic diversity preceded the development of population breadth. See Liao et al. (2013) Nature 496, 469-476. In this study, an individual "CH505" was followed from HIV-1 transmission to development of broadly neutralizing antibodies. This individual developed antibodies targeted to CD4 binding site on gp120. In this individual the virus was sequenced over time, and broadly neutralizing antibody clonal lineage ("CH103") was isolated by antigen-specific B cell sorts, memory B cell culture, and amplified by VH/VL next generation pyrosequencing. The CH103 lineage began by binding the T/F virus, autologous neutralization evolved through somatic mutation and affinity maturation, escape from neutralization drove rapid (clearly by 20 weeks) accumulation of variation in the epitope, antibody breadth followed this viral diversification (FIG. 22-23).

Further analysis of envelopes and antibodies from the CH505 individual indicated that a non-CH103 Lineage participates in driving CH103-BnAb induction. For example V1 loop, V5 loop and CD4 binding site loop mutations escape from CH103 and are driven by CH103 lineage. Loop D mutations enhanced neutralization by CH103 lineage and are driven by another lineage. Transmitted/founder Env, or another early envelope for example W004.26, triggers naïve B cell with CH103 Unmutated Common Ancestor (UCA) which develop in to intermediate antibodies. Transmitted/founder Env, or another early envelope for example W004.26, also triggers non-CH103 autologous neutralizing Abs that drive loop D mutations in Env that have enhanced binding to intermediate and mature CH103 antibodies and drive remainder of the lineage. In certain embodiments, the inventive composition and methods also comprise loop D mutant envelopes (e.g. but not limited to M10, M11, M19, M20, M21, M5, M6, M7, M8, M9) as immunogens. In certain embodiments, the D-loop mutants are included in a composition used as a prime.

The invention provides various methods to choose a subset of viral variants, including but not limited to envelopes, to investigate the role of antigenic diversity in serial samples. In other aspects, the invention provides compositions comprising viral variants, for example but not limited to envelopes, selected based on various criteria as described herein to be used as immunogens. In some embodiments, the immunogens are selected based on the envelope binding to the UCA, and/or intermediate antibodies. In other embodiments the immunogens are selected based on their chronological appearance during infection.

In other aspects, the invention provides immunization strategies using the selections of immunogens to induce cross-reactive neutralizing antibodies. In certain aspects, the immunization strategies as described herein are referred to as "swarm" immunizations to reflect that multiple envelopes are used to induce immune responses. The multiple envelopes in a swarm could be combined in various immunization protocols of priming and boosting.

In certain embodiments the invention provides that sites losing the ancestral, transmitted-founder (T/F) state are most likely under positive selection. From acute, homogenous infections with 3-5 years of follow-up, identified herein are sites of interest among plasma single genome analysis (SGA) Envs by comparing the proportion of sequences per time-point in the T/F state with a threshold, typically 5%. Sites with T/F frequencies below threshold are putative escapes. We then selected clones with representative escape mutations. Where more information was available, such as tree-corrected neutralization signatures and antibody contacts from co-crystal structure, additional sites of interest were considered.

Co-evolution of a broadly neutralizing HIV-1 antibody (CH103) and founder virus was previously reported in African donor (CH505). See Liao et al. (2013) Nature 496, 469-476. In CH505, which had an early antibody that bound autologous T/F virus, we studied 398 envs from 14 time-points over three years (median per sample: 25, range: 18-53). We found 36 sites with T/F frequencies under 20% in any sample. Neutralization and structure data identified 28 and 22 interesting sites, respectively. Together, six gp41 and 53 gp120 sites were identified, plus six V1 or V5 insertions not in HXB2.

The invention provides an approach to select reagents for neutralization assays and subsequently investigate affinity maturation, autologous neutralization, and the transition to heterologous neutralization and breadth. Given the sustained coevolution of immunity and escape this antigen selection based on antibody and antigen coevolution has specific implications for selection of immunogens for vaccine design.

In one embodiment, 100 clones were selected that represent the selected sites. In another embodiment, 101 clones were selected that represent the selected sites. In another embodiment, 103 clones were selected that represent the selected sites. In another embodiment, 104 clones were selected that represent the selected sites. one embodiment, 10 clones were selected that represent the selected sites. In one embodiment, 12 clones were selected that represent the selected sites. In one embodiment, 4 clones were selected that represent the selected sites. These sets of clones represent antigenic diversity by deliberate inclusion of polymorphisms that result from immune selection by neutralizing antibodies, and had a lower clustering coefficient and greater diversity in selected sites than sets sampled randomly. These selections of clones represent various levels of antigenic diversity in the HIV-1 envelope and are based on the genetic diversity of longitudinally sampled SGA envelopes, and correlated with other factors such as antigenic/neutralization diversity, and antibody coevolution.

Sequences/clones

Described herein are nucleic and amino acids sequences of HIV-1 envelopes. In certain embodiments, the described HIV-1 envelope sequences are gp160s. In certain embodiments, the described HIV-1 envelope sequences are gp120s. Other sequences, for example but not limited to gp145s, gp140s, both cleaved and uncleaved, gp150s, gp41s, which are readily derived from the nucleic acid and amino acid gp160 sequences. In certain embodiments the nucleic acid sequences are codon optimized for optimal expression in a host cell, for example a mammalian cell, a rBCG cell or any other suitable expression system.

In certain embodiments, the envelope design in accordance with the present invention involves deletion of residues (e.g., 5-11, 5, 6, 7, 8, 9, 10, or 11 amino acids) at the N-terminus. For delta N-terminal design, amino acid residues ranging from 4 residues or even fewer to 14 residues or even more are deleted. These residues are between the maturation (signal peptide, usually ending with CX, X can be any amino acid) and "VPVXXXX . . . ". In case of CH505 T/F Env as an example, 8 amino acids (italicized and underlined in the below sequence) were deleted: MRVMGIQRNYPQWWIWSMLGFWMLMICNGMWVT-VTVYYGVPVWKEAKTTLFCASDAKAYE KEVHN-VWATHACVPTDPNPQE (SEQ ID NO: 664) . . . (rest of envelope sequence is indicated as ". . . "). In other embodiments, the delta N-design described for CH505 T/F envelope can be used to make delta N-designs of other CH505 envelopes. In certain embodiments, the invention relates generally to an immunogen, gp160, gp120 or gp140, without an N-terminal Herpes Simplex gD tag substituted for amino acids of the N-terminus of gp120, with an HIV leader sequence (or other leader sequence), and without the original about 4 to about 25, for example 11, amino acids of the N-terminus of the envelope (e.g. gp120). See WO2013/006688, e.g. at pages 10-12, the contents of which publication is hereby incorporated by reference in its entirety.

The general strategy of deletion of N-terminal amino acids of envelopes results in proteins, for example gp120s, expressed in mammalian cells that are primarily monomeric, as opposed to dimeric, and, therefore, solves the production and scalability problem of commercial gp120 Env vaccine production. In other embodiments, the amino acid deletions at the N-terminus result in increased immunogenicity of the envelopes.

In certain embodiments, the invention provides envelope sequences, amino acid sequences and the corresponding nucleic acids, and in which the V3 loop is substituted with the following V3loop sequence TRPNNNTRKSIRIG-PGQTFY ATGDIIGNIRQAH (SEQ ID NO: 665). This substitution of the V3 loop reduced product cleavage and improves protein yield during recombinant protein production in CHO cells.

In certain embodiments, the CH505 envelopes will have added certain amino acids to enhance binding of various broad neutralizing antibodies. Such modifications could include but not limited to, mutations at W680G or modification of glycan sites for enhanced neutralization.

In certain aspects, the invention provides composition and methods which use a selection of sequential CH505 Envs, as gp120s, gp140s cleaved and uncleaved, gp145s, gp150s and gp160s, as proteins, DNAs, RNAs, or any combination thereof, administered as primes and boosts to elicit immune response. Sequential CH505 Envs as proteins would be co-administered with nucleic acid vectors containing Envs to amplify antibody induction. In a non-limiting embodiment the CH505 Envs include transmitted/founder, week 53, week 58, week 100 envelopes. In certain embodiments, the compositions and methods include any immunogenic HIV-1 sequences to give the best coverage for T cell help and cytotoxic T cell induction. In certain embodiments, the compositions and methods include mosaic and/or consensus HIV-1 genes to give the best coverage for T cell help and cytotoxic T cell induction. In certain embodiments, the compositions and methods include mosaic group M and/or consensus genes to give the best coverage for T cell help and cytotoxic T cell induction. In some embodiments, the mosaic genes are any suitable gene from the HIV-1 genome. In some embodiments, the mosaic genes are Env genes, Gag genes, Pol genes, Nef genes, or any combination thereof. See e.g. U.S. Pat. No. 7,951,377. In some embodiments the mosaic genes are bivalent mosaics. In some embodiments the mosaic genes are trivalent. In some embodiments, the mosaic genes are administered in a suitable vector with each immunization with Env gene inserts in a suitable vector and/or as a protein. In some embodiments, the mosaic genes, for example as bivalent mosaic Gag group M consensus genes, are administered in a suitable vector, for example but not limited to HSV2, would be administered with each immunization with Env gene inserts in a suitable vector, for example but not limited to HSV-2.

In certain aspects the invention provides compositions and methods of Env genetic immunization either alone or with Env proteins to recreate the swarms of evolved viruses that have led to bnAb induction. Nucleotide-based vaccines offer a flexible vector format to immunize against virtually any protein antigen. Currently, two types of genetic vaccination are available for testing—DNAs and mRNAs.

In certain aspects the invention contemplates using immunogenic compositions wherein immunogens are delivered as DNA. See Graham B S, Enama M E, Nason M C, Gordon I J, Peel S A, et al. (2013) DNA Vaccine Delivered by a Needle-Free Injection Device Improves Potency of Priming for Antibody and CD8+ T-Cell Responses after rAd5 Boost in a Randomized Clinical Trial. PLoS ONE 8(4): e59340, page 9. Various technologies for delivery of nucleic acids, as DNA and/or RNA, so as to elicit immune response, both T-cell and humoral responses, are known in the art and are under developments. In certain embodiments, DNA can be delivered as naked DNA. In certain embodiments, DNA is formulated for delivery by a gene gun. In certain embodiments, DNA is administered by electroporation, or by a needle-free injection technologies, for example but not limited to Biojector® device. In certain embodiments, the DNA is inserted in vectors. The DNA is delivered using a suitable vector for expression in mammalian cells. In certain embodiments the nucleic acids encoding the envelopes are optimized for expression. In certain embodiments DNA is optimized, e.g. codon optimized, for expression. In certain embodiments the nucleic acids are optimized for expression in vectors and/or in mammalian cells. In non-limiting embodiments these are bacterially derived vectors, adenovirus based vectors, rAdenovirus (e.g. Barouch D H, et al. Nature Med. 16: 319-23, 2010), recombinant mycobacteria (e.g. rBCG or M smegmatis) (Yu, J S et al. Clinical Vaccine Immunol. 14: 886-093, 2007; ibid 13: 1204-11, 2006), and recombinant vaccinia type of vectors (Santra S. Nature Med. 16: 324-8, 2010), for example but not limited to ALVAC, replicating (Kibler K V et al., PLoS One 6: e25674, 2011 Nov. 9.) and non-replicating (Perreau M et al. J. virology 85: 9854-62, 2011) NYVAC, modified vaccinia Ankara (MVA)), adeno-associated virus, Venezuelan equine encephalitis (VEE) replicons, Herpes Simplex Virus vectors, and other suitable vectors.

In certain aspects the invention contemplates using immunogenic compositions wherein immunogens are delivered as DNA or RNA in suitable formulations. Various technologies which contemplate using DNA or RNA, or may use complexes of nucleic acid molecules and other entities to be used in immunization. In certain embodiments, DNA or RNA is administered as nanoparticles consisting of low dose antigen-encoding DNA formulated with a block copolymer (amphiphilic block copolymer 704). See Cany et al., Journal of Hepatology 2011 vol. 54 j 115-121; Arnaoty et al., Chapter 17 in Yves Bigot (ed.), Mobile Genetic Elements: Protocols and Genomic Applications, Methods in Molecular Biology, vol. 859, pp293-305 (2012); Arnaoty et al. (2013) Mol Genet Genomics. 2013 Aug;288(7-8):347-63. Nanocarrier technologies called Nanotaxi® for immunogenic macromolecules (DNA, RNA, Protein) delivery are under development. See for example technologies developed by incellart.

In certain aspects the invention contemplates using immunogenic compositions wherein immunogens are delivered as recombinant proteins. Various methods for production and purification of recombinant proteins suitable for use in immunization are known in the art.

The immunogenic envelopes can also be administered as a protein boost in combination with a variety of nucleic acid envelope primes (e.g., HIV-1 Envs delivered as DNA expressed in viral or bacterial vectors).

Dosing of proteins and nucleic acids can be readily determined by a skilled artisan. A single dose of nucleic acid can range from a few nanograms (ng) to a few micrograms GO or milligram of a single immunogenic nucleic acid. Recombinant protein dose can range from a few μg micrograms to a few hundred micrograms, or milligrams of a single immunogenic polypeptide.

Administration: The compositions can be formulated with appropriate carriers using known techniques to yield compositions suitable for various routes of administration. In certain embodiments the compositions are delivered via intramascular (IM), via subcutaneous, via intravenous, via nasal, via mucosal routes, or any other suitable route of immunization.

The compositions can be formulated with appropriate carriers and adjuvants using techniques to yield compositions suitable for immunization. The compositions can include an adjuvant, such as, for example but not limited to, alum, poly IC, MF-59 or other squalene-based adjuvant, ASOIB, or other liposomal based adjuvant suitable for protein or nucleic acid immunization. In certain embodiments, TLR agonists are used as adjuvants. In other embodiment, adjuvants which break immune tolerance are included in the immunogenic compositions.

In certain embodiments, the methods and compositions comprise any suitable agent or immune modulation which could modulate mechanisms of host immune tolerance and release of the induced antibodies. In non-limiting embodiments modulation includes PD-1 blockade; T regulatory cell depletion; CD40L hyperstimulation; soluble antigen administration, wherein the soluble antigen is designed such that the soluble agent eliminates B cells targeting dominant epitopes, or a combination thereof. In certain embodiments, an immunomodulatory agent is administered in at time and in an amount sufficient for transient modulation of the subject's immune response so as to induce an immune response which comprises broad neutralizing antibodies against HIV-1 envelope. Non-limiting examples of such agents is any one of the agents described herein: e.g. chloroquine (CQ), PTP1B Inhibitor-CAS 765317-72-4-Calbiochem or MSI 1436 clodronate or any other bisphosphonate; a Foxol inhibitor, e.g. 344355 |Foxo1 Inhibitor, AS1842856—Calbiochem; Gleevac, anti-CD25 antibody, anti-CCR4 Ab, an agent which binds to a B cell receptor for a dominant HIV-1 envelope epitope, or any combination thereof. In certain embodiments, the methods comprise administering a second immunomodulatory agent, wherein the second and first immunomodulatory agents are different.

There are various host mechanisms that control bNAbs. For example highly somatically mutated antibodies become autoreactive and/or less fit (Immunity 8: 751, 1998; PloS Comp. Biol. 6 e1000800, 2010; J. Thoret. Biol. 164:37, 1993); Polyreactive/autoreactive naïve B cell receptors (unmutated common ancestors of clonal lineages) can lead to deletion of Ab precursors (Nature 373: 252, 1995; PNAS 107: 181, 2010; J. Immunol. 187: 3785, 2011); Abs with long HCDR3 can be limited by tolerance deletion (JI 162: 6060, 1999; JCI 108: 879, 2001). BnAb knock-in mouse models are providing insights into the various mechanisms of tolerance control of MPER BnAb induction (deletion, anergy, receptor editing). Other variations of tolerance control likely will be operative in limiting BnAbs with long HCDR3s, high levels of somatic hypermutations. 2F5 and 4E10 BnAbs were induced in mature antibody knock-in mouse models with MPER peptide-liposome-TLR immunogens. Next step is immunization of germline mouse models and humans with the same immunogens.

The invention is described in the following non-limiting examples.

TABLE 13

Summary of nomenclature used to identify sequences

| | envelope | gp120 | Plasmid ID# | gp145 | Plasmid ID# |
|---|---|---|---|---|---|
| 1. | CH505.M5 | CH505.M5D8gp120 | HV1300531_v2 | CH505.M5gp145 | HV1300656 |
| 2. | CH505.M6 | CH505.M6D8gp120 | HV1300532_v2 | CH505.M6gp145 | HV1300657 |
| 3. | CH505.M7 | CH505.M7D8gp120 | HV1300533_v2 | CH505.M7gp145 | HV1300658 |
| 4. | CH505.M8 | CH505.M8D8gp120 | HV1300534_v2 | CH505.M8gp145 | HV1300659 |
| 5. | CH505.M9 | CH505.M9D8gp120 | HV1300535_v2 | CH505.M9gp145 | HV1300660 |
| 6. | CH505.M10 | CH505.M10D8gp120 | HV1300536_v2 | CH505.M10gp145 | HV1300661 |
| 7. | CH505.M11 | CH505.M11D8gp120 | HV1300537_v2 | CH505.M11gp145 | HV1300662 |
| 8. | CH505.M19 | CH505.M19D8gp120 | HV1300538_v2 | CH505.M19gp145 | HV1300663 |
| 9. | CH505.M20 | CH505.M20D8gp120 | HV1300539_v2 | CH505.M20gp145 | HV1300664 |
| 10. | CH505.M21 | CH505.M21D8gp120 | HV1300540_v2 | CH505.M21gp145 | HV1300665 |
| 11. | CH505TF | CH505TFD8gp120 | HV1300541_v2 | CH505TFgp145 | HV1300631 |
| 12. | CH505w004.03 | CH505w004.03D8gp120 | | CH505w004.03gp145 | HV1300632 |
| 13. | CH505w004.10 | CH505w004.10D8gp120 | HV1300542_v2 | CH505w04.10gp145 | HV1300666 |
| 14. | CH505w014.2 | CH505w014.2D8gp120 | HV1300543_v2 | CH505w14.2gp145 | HV1300667 |
| 15. | CH505w014.3 | CH505w014.3D8gp120 | HV1300544_v2 | CH505w014.3gp145 | HV1300641 |

TABLE 13-continued Summary of nomenclature used to identify sequences

| | envelope | gp120 | Plasmid ID# | gp145 | Plasmid ID# |
|---|---|---|---|---|---|
| 16. | CH505w014.8 | CH505w014.8D8gp120 | HV1300545_v2 | CH505w014.8gp145 | HV1300642 |
| 17. | CH505w014.10 | CH505w014.10D8gp120 | HV1300546_v2 | CH505w14.10gp145 | HV1300668 |
| 18. | CH505w014.21 | CH505w014.21D8gp120 | HV1300547_v2 | CH505w014.21gp145 | HV1300634 |
| 19. | CH505w014.32 | CH505w014.32D8gp120 | HV1300548_v2 | CH505w14.32gp145 | HV1300669 |
| 20. | CH505w020.3 | CH505w020.3D8gp120 | HV1300549_v2 | CH505w20.3gp145 | HV1300670 |
| 21. | CH505w020.4 | CH505w020.4D8gp120 | HV1300550_v2 | CH505w20.4gp145 | HV1300671 |
| 22. | CH505w020.7 | CH505w020.7D8gp120 | HV1300551_v2 | CH505w020.7gp145 | HV1300643 |
| 23. | CH505w020.8 | CH505w020.8D8gp120 | HV1300552_v2 | CH505w20.8gp145 | HV1300672 |
| 24. | CH505w020.9 | CH505w020.9D8gp120 | HV1300553_v2 | CH505w020.9gp145 | HV1300645 |
| 25. | CH505w020.11 | CH505w020.11D8gp120 | HV1300554_v2 | CH505w20.11gp145 | HV1300673 |
| 26. | CH505w020.13 | CH505w020.13D8gp120 | HV1300555_v2 | CH505w20.13gp145* | HV1300684 |
| 27. | CH505w020.14 | CH505w020.14D8gp120 | HV1300556_v2 | CH505w020.14gp145 | HV1300635 |
| 28. | CH505w020.15 | CH505w020.15D8gp120 | HV1300557_v2 | CH505w20.15gp145 | HV1300674 |
| 29. | CH505w020.19 | CH505w020.19D8gp120 | HV1300558_v2 | CH505w20.19gp145 | HV1300675 |
| 30. | CH505w020.22 | CH505w020.22D8gp120 | HV1300559_v2 | CH505w20.22gp145 | HV1300676 |
| 31. | CH505w020.23 | CH505w020.23D8gp120 | HV1300560_v2 | CH505w20.23gp145 | HV1300677 |
| 32. | CH505w020.24 | CH505w020.24D8gp120 | HV1300561_v2 | CH505w20.24gp145 | HV1300678 |
| 33. | CH505w020.26 | CH505w020.26D8gp120 | HV1300562_v2 | CH505w020.26gp145 | HV1300644 |
| 34. | CH505w030.5 | CH505w030.5D8gp120 | HV1300563_v2 | CH505w30.5gp145 | HV1300679 |
| 35. | CH505w030.6 | CH505w030.6D8gp120 | HV1300564_v2 | CH505w30.6gp145 | HV1300680 |
| 36. | CH505w030.9 | CH505w030.9D8gp120 | HV1300565_v2 | CH505w30.9gp145 | HV1300681 |
| 37. | CH505w030.10 | CH505w030.10D8gp120 | HV1300566_v2 | CH505w30.10gp145 | HV1300682 |
| 38. | CH505w030.11 | CH505w030.11D8gp120 | HV1300567_v2 | CH505w30.11gp145 | HV1300683 |
| 39. | CH505w030.13 | CH505w030.13D8gp120 | HV1300568_v2 | CH505w030.13gp145 | HV1300637 |
| 40. | CH505w030.15 | CH505w030.15D8gp120 | HV1300569_v2 | CH505w30.15gp145 | HV1300685 |
| 41. | CH505w030.17 | CH505w030.17D8gp120 | HV1300570_v2 | CH505w30.17gp145 | HV1300686 |
| 42. | CH505w030.18 | CH505w030.18D8gp120 | HV1300571_v2 | CH505w30.18gp145 | HV1300687 |
| 43. | CH505w030.19 | CH505w030.19D8gp120 | HV1300572_v2 | CH505w030.19gp145 | HV1300756 |
| 44. | CH505w030.20 | CH505w030.20D8gp120 | HV1300573_v2 | CH505w30.20gp145 | HV1300688 |
| 45. | CH505w030.21 | CH505w030.21D8gp120 | HV1300574_v2 | CH505w30.21gp145 | HV1300689 |
| 46. | CH505w030.23 | CH505w030.23D8gp120 | HV1300575_v2 | CH505w30.23gp145 | HV1300690 |
| 47. | CH505w030.25 | CH505w030.25D8gp120 | HV1300576_v2 | CH505w30.25gp145 | HV1300691 |
| 48. | CH505w030.27 | CH505w030.27D8gp120 | HV1300577_v2 | CH505w30.27gp145 | HV1300692 |
| 49. | CH505w030.28 | CH505w030.28D8gp120 | HV1300578_v2 | CH505w030.28gp145 | HV1300636 |
| 50. | CH505w030.36 | CH505w030.36D8gp120 | HV1300579_v2 | CH505w30.36gp145 | HV1300693 |
| 51. | CH505w053.3 | CH505w053.3D8gp120 | HV1300580_v2 | CH505w53.3gp145 | HV1300694 |
| 52. | CH505w053.6 | CH505w053.6D8gp120 | HV1300581 | CH505w53.6gp145 | HV1300695 |
| 53. | CH505w053.13 | CH505w053.13D8gp120 | HV1300582 | CH505w053.13gp145 | HV1300649 |
| 54. | CH505w053.16 | CH505w053.16D8gp120 | HV1300583 | CH505w53.16gp145 | HV1300696 |
| 55. | CH505w053.25 | CH505w053.25D8gp120 | HV1300584 | CH505w53.25gp145 | HV1300697 |
| 56. | CH505w053.29 | CH505w053.29D8gp120 | HV1300585 | CH505w53.29gp145 | HV1300698 |
| 57. | CH505w053.31 | CH505w053.31D8gp120 | HV1300586 | CH505w053.31gp145 | HV1300638 |
| 58. | CH505w078.1 | CH505w078.1D8gp120 | HV1300587 | CH505w078.1gp145 | HV1300650 |
| 59. | CH505w078.6 | CH505w078.6D8gp120 | HV1300588 | CH505w78.6gp145 | HV1300699 |
| 60. | CH505w078.7 | CH505w078.7D8gp120 | HV1300589 | CH505w78.7gp145 | HV1300700 |
| 61. | CH505w078.9 | CH505w078.9D8gp120 | HV1300590 | CH505w78.9gp145 | HV1300701 |
| 62. | CH505w078.10 | CH505w078.10D8gp120 | HV1300591 | CH505w78.10gp145 | HV1300702 |
| 63. | CH505w078.15 | CH505w078.15D8gp120 | HV1300592 | CH505w078.15gp145 | HV1300639 |
| 64. | CH505w078.17 | CH505w078.17D8gp120 | HV1300593 | CH505w78.17gp145 | HV1300703 |
| 65. | CH505w078.25 | CH505w078.25D8gp120 | HV1300594 | CH505w78.25gp145 | HV1300704 |
| 66. | CH505w078.33 | CH505w078.33D8gp120 | HV1300595 | CH505w78.33gp145 | HV1300705 |
| 67. | CH505w078.38 | CH505w078.38D8gp120 | HV1300596 | CH505w78.38gp145 | HV1300706 |
| 68. | CH505w100.A3 | CH505w100.A3D8gp120 | HV1300597 | CH505w100.A3gp145 | HV1300707 |
| 69. | CH505w100.A4 | CH505w100.A4D8gp120 | HV1300598 | CH505w100.A4gp145 | HV1300708 |
| 70. | CH505w100.A6 | CH505w100.A6D8gp120 | HV1300599 | CH505w100.A6gp145 | HV1300709 |
| 71. | CH505w100.A10 | CH505w100.A10D8gp120 | HV1300600 | CH505w100.A10gp145 | HV1300710 |
| 72. | CH505w100.A12 | CH505w100.A12D8gp120 | HV1300601 | CH505w100.A12gp145 | HV1300711 |
| 73. | CH505w100.A13 | CH505w100.A13D8gp120 | HV1300602 | CH505w100.A13gp145 | HV1300712 |
| 74. | CH505w100.B2 | CH505w100.B2D8gp120 | HV1300603 | CH505w100.B2gp145 | HV1300713 |
| 75. | CH505w100.B4 | CH505w100.B4D8gp120 | HV1300604 | CH505w100.B4gp145 | HV1300640 |
| 76. | CH505w100.B6 | CH505w100.B6D8gp120 | HV1300605 | CH505w100.B6gp145 | HV1300714 |
| 77. | CH505w100.B7 | CH505w100.B7D8gp120 | HV1300606 | CH505w100.B7gp145 | HV1300715 |
| 78. | CH505w100.C7 | CH505w100.C7D8gp120 | HV1300607 | CH505w100.C7gp145 | HV1300716 |
| 79. | CH505w136.B2 | CH505w136.B2D8gp120 | HV1300608 | CH505w136.B2gp145 | HV1300717 |
| 80. | CH505w136.B3 | CH505w136.B3D8gp120 | HV1300609 | CH505w136.B3gp145 | HV1300718 |
| 81. | CH505w136.B4 | CH505w136.B4D8gp120 | HV1300610 | CH505w136.B4gp145 | HV1300719 |
| 82. | CH505w136.B5 | CH505w136.B5D8gp120 | HV1300611 | CH505w136.B5gp145 | HV1300720 |
| 83. | CH505w136.B8 | CH505w136.B8D8gp120 | HV1300612 | CH505w136.B8gp145 | HV1300721 |
| 84. | CH505w136.B10 | CH505w136.B10D8gp120 | HV1300613 | CH505w136.B10gp145 | HV1300722 |
| 85. | CH505w136.B12 | CH505w136.B12D8gp120 | HV1300614 | CH505w136.B12gp145 | HV1300723 |
| 86. | CH505w136.B18 | CH505w136.B18D8gp120 | HV1300615 | CH505w136.B18gp145 | HV1300724 |
| 87. | CH505w136.B20 | CH505w136.B20D8gp120 | HV1300616 | CH505w136.B20gp145 | HV1300725 |
| 88. | CH505w136.B27 | CH505w136.B27D8gp120 | HV1300617 | CH505w136.B27gp145 | HV1300726 |
| 89. | CH505w136.B29 | CH505w136.B29D8gp120 | HV1300618 | CH505w136.B29gp145 | HV1300727 |
| 90. | CH505w136.B36 | CH505w136.B36D8gp120 | HV1300619 | CH505w136.B36gp145 | HV1300728 |
| 91. | CH505w160.A1 | CH505w160.A1D8gp120 | HV1300620 | CH505w160.A1gp145 | HV1300729 |

TABLE 13-continued

Summary of nomenclature used to identify sequences

| | envelope | gp120 | Plasmid ID# | gp145 | Plasmid ID# |
|---|---|---|---|---|---|
| 92. | CH505w160.C2 | CH505w160.C2D8gp120 | HV1300621 | CH505w160.C2gp145 | HV1300730 |
| 93. | CH505w160.C4 | CH505w160.C4D8gp120 | HV1300622 | CH505w160.C4gp145 | HV1300731 |
| 94. | CH505w160.C11 | CH505w160.C11D8gp120 | HV1300623 | CH505w160.C11gp145 | HV1300732 |
| 95. | CH505w160.C12 | CH505w160.C12D8gp120 | HV1300624 | CH505w160.C12gp145 | HV1300733 |
| 96. | CH505w160.C14 | CH505w160.C14D8gp120 | HV1300625 | CH505w160.C14gp145 | HV1300734 |
| 97. | CH505w160.D1 | CH505w160.D1D8gp120 | HV1300626 | CH505w160.D1gp145 | HV1300735 |
| 98. | CH505w160.D5 | CH505w160.D5D8gp120 | HV1300627 | CH505w160.D5gp145 | HV1300736 |
| 99. | CH505w160.T2 | CH505w160.T2D8gp120 | HV1300628 | CH505w160.T2gp145 | HV1300737 |
| 100. | CH505w160.T4 | CH505w160.T4D8gp120 | HV1300629 | CH505w160.T4gp145 | HV1300738 |
| 101. | CH505.w4.26 | CH505.w4.26D8gp120 | HV1300777 | CH505.w4.26gp145 | HV1300633 |
| 102. | CH505.w30.12 | CH505.w30.12D8gp120 | HV1300778 | CH505.w30.12gp145 | HV1300646 |
| 103. | CH505.w53.19 | CH505.w53.19D8gp120 | HV1300779 | CH505.w53.19gp145 | HV1300648 |
| 104. | CH05w020.2. | CH05w020.2.D8gp120 | HV1300749 | CH505w020.2.gp145 | HV1300748 | identified both the nucleic acid (FIG. 16, and 21) and amino acid sequences (FIGS. 18 20).

TABLE 14 shows a summary of sequence names and sequence identifiers.

| | Name | Gp160 aa SEQ ID NO | Gp160 nt SEQ ID NO | Gp145 aa SEQ ID NO | Gp145 nt SEQ ID NO | Gp120 aa D8 SEQ ID NO | Gp120D nt SEQ ID NO |
|---|---|---|---|---|---|---|---|
| 1. | CH505.M5 | 307 | 102 | 469 | 573 | 322 | 113 |
| 2. | CH505.M6 | 316 | 111 | 470 | 574 | 323 | 114 |
| 3. | CH505.M7 | 312 | 107 | 471 | 575 | 324 | 115 |
| 4. | CH505.M8 | 314 | 109 | 472 | 576 | 325 | 116 |
| 5. | CH505.M9 | 311 | 106 | 473 | 577 | 326 | 117 |
| 6. | CH505.M10 | 309 | 104 | 474 | 578 | 327 | 118 |
| 7. | CH505.M11 | 310 | 105 | 475 | 579 | 328 | 119 |
| 8. | CH505.M19 | 308 | 103 | 476 | 580 | 329 | 120 |
| 9. | CH505.M20 | 313 | 108 | 477 | 581 | 330 | 121 |
| 10. | CH505.M21 | 315 | 110 | 478 | 582 | 331 | 122 |
| 11. | CH505TF | 216 | 11 | 450 | 554 | 332* | 123* |
| 12. | CH505w004.03 | 217 | 12 | 451 | 555 | 332* | 123* |
| 13. | CH505w004.10 | 219 | 14 | 479 | 583 | 333 | 124 |
| 14. | CH505w014.2 | 222 | 17 | 480 | 584 | 334 | 125 |
| 15. | CH505w014.3 | 220 | 15 | 460 | 564 | 335 | 126 |
| 16. | CH505w014.8 | 225 | 20 | 461 | 565 | 336 | 127 |
| 17. | CH505w014.10 | 224 | 19 | 481 | 585 | 337 | 128 |
| 18. | CH505w014.21 | 223 | 18 | 453 | 557 | 338 | 129 |
| 19. | CH505w014.32 | 221 | 16 | 482 | 586 | 339 | 130 |
| 20. | CH505w020.3 | 239 | 34 | 483 | 587 | 340 | 131 |
| 21. | CH505w020.4 | 229 | 24 | 484 | 588 | 341 | 132 |
| 22. | CH505w020.7 | 227 | 22 | 462 | 566 | 342 | 133 |
| 23. | CH505w020.8 | 230 | 25 | 485 | 589 | 343 | 134 |
| 24. | CH505w020.9 | 236 | 31 | 464 | 568 | 344 | 135 |
| 25. | CH505w020.11 | 233 | 28 | 486 | 590 | 345 | 136 |
| 26. | CH505w020.13 | 238 | 33 | 497 | 600 | 346 | 137 |
| 27. | CH505w020.14 | 231 | 26 | 454 | 558 | 347 | 138 |
| 28. | CH505w020.15 | 232 | 27 | 487 | 591 | 348 | 139 |
| 29. | CH505w020.19 | 237 | 32 | 488 | 592 | 349 | 140 |
| 30. | CH505w020.22 | 226 | 21 | 489 | 593 | 350 | 141 |
| 31. | CH505w020.23 | 234 | 29 | 490 | 594 | 351 | 142 |
| 32. | CH505w020.24 | 235 | 30 | 491 | 595 | 352 | 143 |
| 33. | CH505w020.26 | 228 | 23 | 463 | 567 | 353 | 144 |
| 34. | CH505w030.5 | 249 | 44 | 492 | 666 | 354 | 145 |
| 35. | CH505w030.6 | 243 | 38 | 493 | 596 | 355 | 146 |
| 36. | CH505w030.9 | 247 | 42 | 494 | 597 | 356 | 147 |
| 37. | CH505w030.10 | 253 | 48 | 495 | 598 | 357 | 148 |
| 38. | CH505w030.11 | 240 | 35 | 496 | 599 | 358 | 149 |
| 39. | CH505w030.13 | 255 | 50 | 456 | 560 | 359 | 150 |
| 40. | CH505w030.15 | 252 | 47 | 498 | 601 | 360 | 151 |
| 41. | CH505w030.17 | 242 | 37 | 499 | 602 | 361 | 152 |
| 42. | CH505w030.18 | 246 | 41 | 500 | 603 | 362 | 153 |
| 43. | CH505w030.19 | 256 | 51 | 553 | 656 | 363 | 154 |
| 44. | CH505w030.20 | 241 | 36 | 501 | 604 | 364 | 155 |
| 45. | CH505w030.21 | 245 | 40 | 502 | 605 | 365 | 156 |
| 46. | CH505w030.23 | 251 | 46 | 503 | 606 | 366 | 157 |
| 47. | CH505w030.25 | 244 | 39 | 504 | 607 | 367 | 158 |
| 48. | CH505w030.27 | 250 | 45 | 505 | 608 | 368 | 159 |
| 49. | CH505w030.28 | 254 | 49 | 455 | 559 | 369 | 160 |
| 50. | CH505w030.36 | 248 | 43 | 506 | 609 | 370 | 161 |

TABLE 14-continued shows a summary of sequence names and sequence identifiers.

| | Name | Gp160 aa SEQ ID NO | Gp160 nt SEQ ID NO | Gp145 aa SEQ ID NO | Gp145 nt SEQ ID NO | Gp120 aa D8 SEQ ID NO | Gp120D nt SEQ ID NO |
|---|---|---|---|---|---|---|---|
| 51. | CH505w053.3 | 257 | 52 | 507 | 610 | 371 | 162 |
| 52. | CH505w053.6 | 259 | 54 | 508 | 611 | 372 | 163 |
| 53. | CH505w053.13 | 263 | 58 | 467 | 571 | 373 | 164 |
| 54. | CH505w053.16 | 262 | 57 | 509 | 612 | 374 | 165 |
| 55. | CH505w053.25 | 260 | 55 | 510 | 613 | 375 | 166 |
| 56. | CH505w053.29 | 258 | 53 | 511 | 614 | 376 | 167 |
| 57. | CH505w053.31 | 261 | 56 | 457 | 561 | 377 | 168 |
| 58. | CH505w078.1 | 269 | 64 | 468 | 572 | 378 | 169 |
| 59. | CH505w078.6 | 264 | 59 | 512 | 615 | 379 | 170 |
| 60. | CH505w078.7 | 273 | 68 | 513 | 616 | 380 | 171 |
| 61. | CH505w078.9 | 266 | 61 | 514 | 617 | 381 | 172 |
| 62. | CH505w078.10 | 271 | 66 | 515 | 618 | 382 | 173 |
| 63. | CH505w078.15 | 270 | 65 | 458 | 562 | 383 | 174 |
| 64. | CH505w078.17 | 268 | 63 | 516 | 619 | 384 | 175 |
| 65. | CH505w078.25 | 265 | 60 | 517 | 620 | 385 | 176 |
| 66. | CH505w078.33 | 267 | 62 | 518 | 621 | 386 | 177 |
| 67. | CH505w078.38 | 272 | 67 | 519 | 622 | 387 | 178 |
| 68. | CH505w100.A3 | 278 | 73 | 520 | 623 | 388 | 179 |
| 69. | CH505w100.A4 | 276 | 71 | 521 | 624 | 389 | 180 |
| 70. | CH505w100.A6 | 274 | 69 | 522 | 625 | 390 | 181 |
| 71. | CH505w100.A10 | 277 | 72 | 523 | 626 | 391 | 182 |
| 72. | CH505w100.A12 | 275 | 70 | 524 | 627 | 392 | 183 |
| 73. | CH505w100.A13 | 284 | 79 | 525 | 628 | 393 | 184 |
| 74. | CH505w100.B2 | 279 | 74 | 526 | 629 | 394 | 185 |
| 75. | CH505w100.B4 | 280 | 75 | 459 | 563 | 395 | 186 |
| 76. | CH505w100.B6 | 283 | 78 | 527 | 630 | 396 | 187 |
| 77. | CH505w100.B7 | 282 | 77 | 528 | 631 | 397 | 188 |
| 78. | CH505w100.C7 | 281 | 76 | 529 | 632 | 398 | 189 |
| 70. | CH505w136.B2 | 294 | 89 | 530 | 633 | 399 | 190 |
| 80. | CH505w136.B3 | 295 | 90 | 531 | 634 | 400 | 191 |
| 81. | CH505w136.B4 | 288 | 83 | 532 | 635 | 401 | 192 |
| 82. | CH505w136.B5 | 293 | 88 | 533 | 636 | 402 | 193 |
| 81 | CH505w136.B8 | 290 | 85 | 534 | 637 | 403 | 194 |
| 84. | CH505w136.B10 | 285 | 80 | 535 | 638 | 404 | 195 |
| 85. | CH505w136.B12 | 287 | 82 | 536 | 639 | 405 | 196 |
| 86. | CH505w136.B18 | 296 | 91 | 537 | 640 | 406 | 197 |
| 87. | CH505w136.B20 | 292 | 87 | 538 | 641 | 407 | 198 |
| 88. | CH505w136.B27 | 286 | 81 | 539 | 642 | 408 | 199 |
| 80. | CH505w136.B29 | 289 | 84 | 540 | 643 | 409 | 200 |
| 90. | CH505w136.B36 | 291 | 86 | 541 | 644 | 410 | 201 |
| 91. | CH505w160.A1 | 297 | 92 | 542 | 645 | 411 | 202 |
| 92. | CH505w160.C2 | 301 | 96 | 543 | 646 | 412 | 203 |
| 93. | CH505w160.C4 | 302 | 97 | 544 | 647 | 413 | 204 |
| 94. | CH505w160.C11 | 298 | 93 | 545 | 648 | 414 | 205 |
| 95. | CH505w160.C12 | 299 | 94 | 546 | 649 | 415 | 206 |
| 96. | CH505w160.C14 | 300 | 95 | 547 | 650 | 416 | 207 |
| 97. | CH505w160.D1 | 303 | 98 | 548 | 651 | 417 | 208 |
| 98. | CH505w160.D5 | 304 | 99 | 549 | 652 | 418 | 209 |
| 99. | CH505w160.T2 | 305 | 100 | 550 | 653 | 419 | 210 |
| 100. | CH505w160.T4 | 306 | 101 | 551 | 654 | 420 | 211 |
| 101. | CH505.w4.26 | 318 | 13 | 452 | 556 | 422 | 213 |
| 102. | CH505.w30.12 | 319 | | | | 423 | 214 |
| 103. | CH505.w53.19 | 320 | | | | 424 | 215 |
| 104. | CH05w020.2 | 321 | | | 655 | 421 | 212 |
| | Other sequences | | | | | | |
| | CH505 virus | 1 | | | | | |
| | CH505 viral | 2; | | | | | |
| | genes: Gag, Pol, | 3; | | | | | |
| | Vif, Vpr, Tat, | 4; | | | | | |
| | Rev, VPU, Env, | 5; | | | | | |
| | Nef, respectively | 6; | | | | | |
| | | 7; | | | | | |
| | | 8; | | | | | |
| | | 9; | | | | | |
| | | 10 | | | | | |

*The gp120 aa and nt sequence for TF and w004.3 envelope is the same.

EXAMPLES

Example 1

HIV-1 sequences, including envelopes, and antibodies from HIV-1 infected individual CH505 were isolated as described in Liao et al. (2013) Nature 496, 469-476 including supplementary materials.

Recombinant HIV-1 Proteins

HIV-1 Env genes for subtype B, 63521, subtype C, 1086, and subtype CRF_01, 427299, as well as subtype C, CH505 autologous transmitted/founder Env were obtained from acutely infected HIV-1 subjects by single genome amplification, codon-optimized by using the codon usage of highly expressed human housekeeping genes, de novo synthesized (GeneScript) as gp140 or gp120 (AE.427299) and cloned into a mammalian expression plasmid pcDNA3.1/hygromycin (Invitrogen). Recombinant Env glycoproteins were produced in 293F cells cultured in serum-free medium and transfected with the HIV-1 gp140- or gp120-expressing pcDNA3.1 plasmids, purified from the supernatants of transfected 293F cells by using $Galanthus$ $nivalis$ lectin-agarose (Vector Labs) column chromatography, and stored at $-80\,^\circ$C. Select Env proteins made as CH505 transmitted/founder Env were further purified by superose 6 column chromatography to trimeric forms, and used in binding assays that showed similar results as with the lectin-purified oligomers.

ELISA

Binding of patient plasma antibodies and CH103 clonal lineage antibodies to autologous and heterologous HIV-1 Env proteins was measured by ELISA as described previously. Plasma samples in serial threefold dilutions starting at 1:30 to 1:521,4470 or purified monoclonal antibodies in serial threefold dilutions starting at 100 μg ml−1 to 0.000 μg ml−1 diluted in PBS were assayed for binding to autologous and heterologous HIV-1 Env proteins. Binding of biotin-labelled CH103 at the subsaturating concentration was assayed for cross-competition by unlabelled HIV-1 antibodies and soluble CD4-Ig in serial fourfold dilutions starting at 10 μg ml−1. The half-maximal effective concentration (EC50) of plasma samples and monoclonal antibodies to HIV-1 Env proteins were determined and expressed as either the reciprocal dilution of the plasma samples or concentration of monoclonal antibodies.

Surface plasmon resonance affinity and kinetics measurements

Binding Kd and rate constant (association rate (Ka)) measurements of monoclonal antibodies and all candidate UCAs to the autologous Env C. CH05 gp140 and/or the heterologous Env B.63521 gp120 were carried out on BIAcore 3000 instruments as described previously. Anti-human IgG Fc antibody (Sigma Chemicals) was immobilized on a CM5 sensor chip to about 15,000 response units and each antibody was captured to about 50-200 response units on three individual flow cells for replicate analysis, in addition to having one flow cell captured with the control Synagis (anti-RSV) monoclonal antibody on the same sensor chip. Double referencing for each monoclonal antibody-HIV-1 Env binding interactions was used to subtract nonspecific binding and signal drift of the Env proteins to the control surface and blank buffer flow, respectively. Antibody capture level on the sensor surface was optimized for each monoclonal antibody to minimize rebinding and any associated avidity effects. C.CH505 Env gp140 protein was injected at concentrations ranging from 2 to 25 μg ml−1, and B.63521 gp120 was injected at 50-400 μg ml−1 for UCAs and early intermediates IA8 and IA4, 10-100 μg ml−1 for intermediate IA3, and 1-25 μg ml−1 for the distal and mature monoclonal antibodies. All curve-fitting analyses were performed using global fit of to the 1:1 Langmuir model and are representative of at least three measurements. All data analysis was performed using the BIAevaluation 4.1 analysis software (GE Healthcare).

Neutralization assays

Neutralizing antibody assays in TZM-bl cells were performed as described previously. Neutralizing activity of plasma samples in eight serial threefold dilutions starting at 1:20 dilution and for recombinant monoclonal antibodies in eight serial threefold dilutions starting at 50 μg ml−1 were tested against autologous and herologous HIV-1 Env-pseudotyped viruses in TZM-bl-based neutralization assays using the methods known in the art. Neutralization breadth of CH103 was determined using a panel of 196 of geographically and genetically diverse Env-pseudoviruses representing the major circulated genetic subtypes and circulating recombinant forms. HIV-1 subtype robustness is derived from the analysis of HIV-1 clades over time. The data were calculated as a reduction in luminescence units compared with control wells, and reported as IC50 in either reciprocal dilution for plasma samples or in micrograms per microlitre for monoclonal antibodies.

The GenBank accession numbers for 292 CH505 Env proteins are KC247375-KC247667, and accessions for 459 $V_H DJ_H$ and 174 $V_L J_L$ sequences of antibody members in the CH103 clonal lineage are KC575845-KC576303 and KC576304-KC576477, respectively.

Example 2

Combinations of antigens derived from CH505 envelope sequences for swarm Immunizations Provided herein are non-limiting examples of combinations of antigens derived from CH505 envelope sequences for a swarm immunization. The selection includes priming with a virus which binds to the UCA, for example a T/F virus or another early (e.g. but not limited to week 004.3, or 004.26) virus envelope. In certain embodiments the prime could include D-loop variants. In certain embodiments the boost could include D-loop variants. In certain embodiments, these D-loop variants are envelope escape mutants not recognized by the UCA. Non-limiting examples of such D-loop variants are envelopes designated as M10, M11, M19, M20, M21, M5, M6, M7, M8, M9, M14 (TF$_{13}$M14), M24 (TF$_{13}$24), M15, M16, M17, M18, M22, M23, M24, M25, M26.

Non-limiting embodiments of envelopes selected for swarm vaccination are shown as the selections described below. A skilled artisan would appreciate that a vaccination protocol can include a sequential immunization starting with the "prime" envelope(s) and followed by sequential boosts, which include individual envelopes or combination of envelopes. In another vaccination protocol, the sequential immunization starts with the "prime" envelope(s) and is followed with boosts of cumulative prime and/or boost envelopes (for e.g. Table 5). In certain embodiments, the prime does not include T/F sequence (W000.TF). In certain embodiments, the prime includes w004.03 envelope. In certain embodiments, the prime includes w004.26 envelope. In certain embodiments, the immunization methods do not include immunization with HIV-1 envelope T/F. In other embodiments for example the T/F envelope may not be included when w004.03 or w004.26 envelope is included. In certain embodiments, the immunization methods do not include a schedule of four valent immunization with HIV-1 envelopes T/F, w053.16, w078.33, and w100.B6.

In certain embodiments, there is some variance in the immunization regimen; in some embodiments, the selection of HIV-1 envelopes may be grouped in various combinations of primes and boosts, either as nucleic acids, proteins, or combinations thereof.

In certain embodiments the immunization includes a prime administered as DNA, and MVA boosts. See Goepfert, et al. 2014; "Specificity and 6-Month Durability of Immune Responses Induced by DNA and Recombinant Modified Vaccinia Ankara Vaccines Expressing HIV-1 Virus-Like Particles" J Infect Dis. 2014 Feb. 9. [Epub ahead of print].

HIV-1 Envelope selection A (four envelopes): w004.03 (T/F or w004.03), w053.16, w078.33, and w100.B6.
1: Prime: w004.03 (T/F or w004.03)
2: Boost: w053.16,
3: Boost: w078.33.
4: Boost: w100.B6.

HIV-1 Envelope selection B (ten envelopes): w004.03 (T/F or w004.03), M11, w030.28, w053.16, w053.31, w078.7, w078.15, w078.33, w100.A4, w100.B6.
1: Prime: w004.03 (T/F or w004.03), M11.
2: Boost: w030.28.
3: Boost: w053.16, w053.31, w078.7, w078.15, w078.33.
4: Boost with: w100.A4, w100.B6.

HIV-1 Envelope selection C (twelve envelopes): w004.03 (T/F or w004.03), M11, w014.32, w014.12, w030.28, w053.16, w053.31, w078.7, w078.15, w078.33, w100.A4, w100.B6.
1: Prime: w004.03 (T/F or w004.03), M11.
2: Boost: w014.32, w014.12
3: Boost: w030.28.
4: Boost: w053.16, w053.31, w078.7, w078.15, w078.33.
5: Boost with: w100.A4, w100.B6.

HIV-1 Envelope selection D (twelve envelopes): w004.03 (T/F or w004.03), M11, w014.32, w014.12, w030.28, w053.16, w053.31, w078.7, w078.15, w078.33, w100.A4, w100.B6.
1: Prime: w004.03 (T/F or w004.03), M11; w014.32, w014.12
2: Boost: w030.28.
3: Boost: w053.16, w053.31, w078.7, w078.15, w078.33. 4: Boost with: w100.A4, w100.B6.

HIV-1 Envelope selection E (excludes # viruses from selections in Table 3 and 3A):
1: Prime: w000.TF, w004.03, M10, M11, M19, M20, M21, M5, M7, M8, M9.
2: Boost with: w014.10, w014.2, w014.21, w014.3, w014.32, w014.8 w020.3, w020.4, w020.7, w020.8, w020.9, w020.11, w020.13, w020.15, w020.19, w020.22, w020.23, w020.24, w020.26
3: Boost with: w030.5, w030.6, w030.9, w030.10, w030.11, w030.13, w030.15, w030.17, w030.18, w030.19, w030.20, w030.21, w030.23, w030.25, w030.27, w030.28, w030.36
4: Boost with: w053.3, w053.6, w053.13, w053.16, w053.25, w053.29, w053.31, w078.1, w078.6, w078.7, w078.9, w078.10, w078.15, w078.17, w078.33, w078.38
5: Boost with: w100.A3, w100.A4, w100.A6, w100.A10, w100.Al2, w100.A13, w100.B2, w100.B6, w100.B7, w136.B2, w136.B3, w136.B4, w136.B5, w136.B8, w136.B10, w136.B12, w136.B18, w136.B20, w136.B27, w136.B29, w136.B36, w160.A1, w160.C1, w160.C2, w160.C4, w160.C11, w160.C12, w160.C14, w160.D1, w160.D5, w160.T2, w160.T4.

HIV-1 Envelope selection F (one hundred envelopes) (Table 3):

1: Prime: w000.TF, w004.03, M10, M11, M19, M20, M21, M5, M6, M7, M8, M9.
2: Boost: w014.10, w014.2, w014.21, w014.3, w014.32, w014.8 w020.3, w020.4, w020.7, w020.8, w020.9, w020.11, w020.13, w020.14, w020.15, w020.19, w020.22, w020.23, w020.24, w020.26
3: Boost: w030.5, w030.6, w030.9, w030.10, w030.11, w030.13, w030.15, w030.17, w030.18, w030.19, w030.20, w030.21, w030.23, w030.25, w030.27, w030.28, w030.36
4: Boost: w053.3, w053.6, w053.13, w053.16, w053.25, w053.29, w053.31, w078.1, w078.6, w078.7, w078.9, w078.10, w078.15, w078.17, w078.25, w078.33, w078.38
5: Boost: w100.A3, w100.A4, w100.A6, w100.A10, w100.Al2, w100.A13, w100.B2, w100.B4, w100.B6, w100.B7, w100.C7, w136.B2, w136.B3, w136.B4, w136.B5, w136.B8, w136.B10, w136.B12, w136.B18, w136.B20, w136.B27, w136.B29, w136.B36, w160.A1, w160.C1, w160.C2, w160.C4, w160.C11, w160.C12, w160.C14, w160.D1, w160.D5, w160.T2, w160.T4.

HIV-1 Envelope selection G (101 envelopes) (Table 3A):

1. Prime: w000.TF, w004.03, w004.26, M10, M11, M19, M20, M21, M5, M6, M7, M8, M9
2. Boost: w014.10, w014.2, w014.21, w014.3, w014.32, w014.8, w020.3, w020.4, w020.7, w020.8, w020.9, w020.11, w020.13, w020.14, w020.15, w020.19, w020.22, w020.23, w020.24, w020.26
3. Boost: w030.5, w030.6, w030.9, w030.10, w030.11, w030.13, w030.15, w030.17, w030.18, w030.19, w030.20, w030.21, w030.23, w030.25, w030.27, w030.28, w030.36
4. Boost: w053.3, w053.6, w053.13, w053.16, w053.25, w053.29, w053.31, w078.1, w078.6, w078.7, w078.9, w078.10, w078.15, w078.17, w078.25, w078.33, w078.38
5. Boost: w100.A3, w100.A4, w100.A6, w100.A10, w100.Al2, w100.A13, w100.B2, w100.B4, w100.B6, w100.B7, w100.C7, w136.B2, w136.B3, w136.B4, w136.B5, w136.B8, w136.B10, w136.B12, w136.B18, w136.B20, w136.B27, w136.B29, w136.B36, w160.A1, w160.C1, w160.C2, w160.C4, w160.C11, w160.C12, w160.C14, w160.D1, w160.D5, w160.T2, w160.T4.

HIV-1 envelope selection H (eight envelopes) M11, w004.03, w030.28, w053.16, w053.31, w078.15, w078.33, w100.B6

HIV-1 envelope selection I (ten envelopes) M11, M14, M24, w004.03, w030.28, w053.16, w053.31, w078.15, w078.33, w100.B6. in some embodiments M11+w004.03, then wk030.28+wk 078.15 then wk 053.31+wk 078.7, then w100 B6+w 100. A4 week 53.16, week 78.33; Alternatively they can be administered all together as a swarm in 4 or 5 prime and boosts with or without DNA accompanyments.

HIV-1 envelope selection J (twelve envelopes) M11, M14, M24, w004.03, w030.28, w053.16, w053.31, w078.07, w078.15, w078.33, w100.B6, w100.A4.

HIV-1 envelope selection K (ten envelopes) M11, w004.03, w030.28, w053.16, w053.31, w078.07, w078.15, w078.33, w100.B6, w100.A4).

HIV-1 envelope selection L (104 envelopes as gp160s, gp145s, gp140s; 103 envelopes as gp120D8s; See Tables 13 and 14): CH505.M5; CH505.M6; CH505.M7; CH505.M8; CH505.M9; CH505.M10; CH505.M11; CH505.M19; CH505.M20; CH505.M21; CH505TF; CH505w004.03; CH505w004.10; CH505w014.2; CH505w014.3;

CH505w014.8;    CH505w014.10;   CH505w014.21;
CH505w014.32;   CH505w020.3;    CH505w020.4;
CH505w020.7;    CH505w020.8;    CH505w020.9;
CH505w020.11;   CH505w020.13;   CH505w020.14;
CH505w020.15;   CH505w020.19;   CH505w020.22;
CH505w020.23;   CH505w020.24;   CH505w020.26;
CH505w030.5;    CH505w030.6;    CH505w030.9;
CH505w030.10;   CH505w030.11;   CH505w030.13;
CH505w030.15;   CH505w030.17;   CH505w030.18;
CH505w030.19;   CH505w030.20;   CH505w030.21;
CH505w030.23;   CH505w030.25;   CH505w030.27;
CH505w030.28;   CH505w030.36;   CH505w053.3;
CH505w053.6;    CH505w053.13;   CH505w053.16;
CH505w053.25;   CH505w053.29;   CH505w053.31;
CH505w078.1;    CH505w078.6;    CH505w078.7;
CH505w078.9;    CH505w078.10;   CH505w078.15;
CH505w078.17;   CH505w078.25;   CH505w078.33;
CH505w078.38;   CH505w100.A3;   CH505w100.A4;
CH505w100.A6;   CH505w100.A10;  CH505w100.A12;
CH505w100.A13;  CH505w100.B2;   CH505w100.B4;
CH505w100.B6;   CH505w100.B7;   CH505w100.C7;
CH505w136.B2;   CH505w136.B3;   CH505w136.B4;
CH505w136.B5;   CH505w136.B8;   CH505w136.B10;
CH505w136.B12;  CH505w136.B18;  CH505w136.B20;
CH505w136.B27;  CH505w136.B29;  CH505w136.B36;
CH505w160.A1;   CH505w160.C2;   CH505w160.C4;
CH505w160.C11;  CH505w160.C12;  CH505w160.C14;
CH505w160.D1;   CH505w160.D5;   CH505w160.T2;
CH505w160.T4;   CH505.w4.26  ;  CH505.w30.12  ;
CH505.w53.19 ; C505w020.2.

The selections of CH505-Envs were down-selected from a series of 400 CH505 Envs isolated by single-genome amplification followed for 3 years after acute infection, based on experimental data. The enhanced neutralization breadth that developed in the CD4-binding site (bs) CH103 antibody lineage that arose in subject CH505 developed in conjunction with epitope diversification in the CH505's viral quasispecies. It was observed that at 6 months post-infection in there was more diversification in the CD4bs epitope region in this donor than sixteen other acutely infected donors. Population breadth did not arise in the CH103 antibody lineage until the epitope began to diversify. A hypothesis is that the CH103 linage drove viral escape, but then the antibody adapted to the relatively resistant viral variants. As this series of events was repeated, the emerging antibodies evolved to tolerate greater levels of diversity in relevant sites, and began to be able to recognize and neutralize diverse heterologous forms for the virus and manifest population breadth. In certain embodiments, eight envs are selected from CH505 sequences to reflect diverse variants for making Env pseudoviruses, with the goal of recapitulating CH505 HIV-1 antigenic diversity over time, making sure selected site (i.e. those sites reflecting major antigenic shifts) diversity was represented.

Specifically, for CH505 the virus and envelope evolution were mapped, and the CH103 CD4 binding-site bnAb evolution. In addition, 135 CH505 varied envelope pseudotyped viruses were made and tested them for neutralization sensitivity by members of the CH103 bnAb lineage (e.g, FIGS. 13, 29-30). From this large dataset, in one embodiment, eight Env variants were chosen for immunization based on three major criteria: Env mutants with sites under diversifying selection, in which the transmitted/founder (T/F) Env form vanished below 20% in any sample, i.e. escape variants; signature sites based on autologous neutralization data, i.e. Envs with statistically supported signatures for escape from members of the CH103 bnAb lineage; and sites with mutations at the contact sites of the CH103 antibody and HIV Env. From a set of candidate envs, eight Envs with mutations in these characteristic sites and representative of Envs with these criteria were chosen. In this manner, a sequential swarm of Envs was selected for immunization to represent the progression of virus escape mutants that evolved during bnAb induction and increasing neutralization breadth in the CH505 donor.

In certain embodiments, additional two sequences are selected to contain five additional specific amino acid signatures of resistance that were identified at the global population level. These sequences contain statistically defined resistance signatures, which are common at the population level and enriched among heterologous viruses that CH103 fails to neutralize. When they were introduced into the TF sequence, they were experimentally shown to confer partial resistance to antibodies in the CH103 lineage. Following the reasoning that serial viral escape and antibody adaptation to escape is what ultimate selects for neutralizing antibodies that exhibit breadth and potency against diverse variants, in certain embodiments, inclusion of these variants in a vaccine may extend the breadth of vaccine-elicited antibodies even beyond that of the CH103 lineage. Thus the overarching goal will be to trigger a CH103-like lineage first using the CH505TF modified M11, that is well recognized by early CH103 ancestral states, then vaccinating with antigenic variants, to allow the antibody lineage to adapt through somatic mutation to accommodate the natural variants that arose in CH505. In certain embodiments, vaccination regimens include a total of eight sequences (Selection H) that capture the antigenic diversity of CH505. In another embodiment, the two sequences that introduce the population signatures are added (Selection I), to enable the induction of antibodies by vaccination that may have even greater breadth than those isolated from CH505.

The eight CH505 sequences that represent the accumulation of viral sequence and antigenic diversity in the CD4bs epitope of CH103 in subject CH505: M11 (TF with N279D+V281G), w004.03, w030.28, w053.16, w053.31, w078.15, w078.33, w100.B6.

Figure 29:
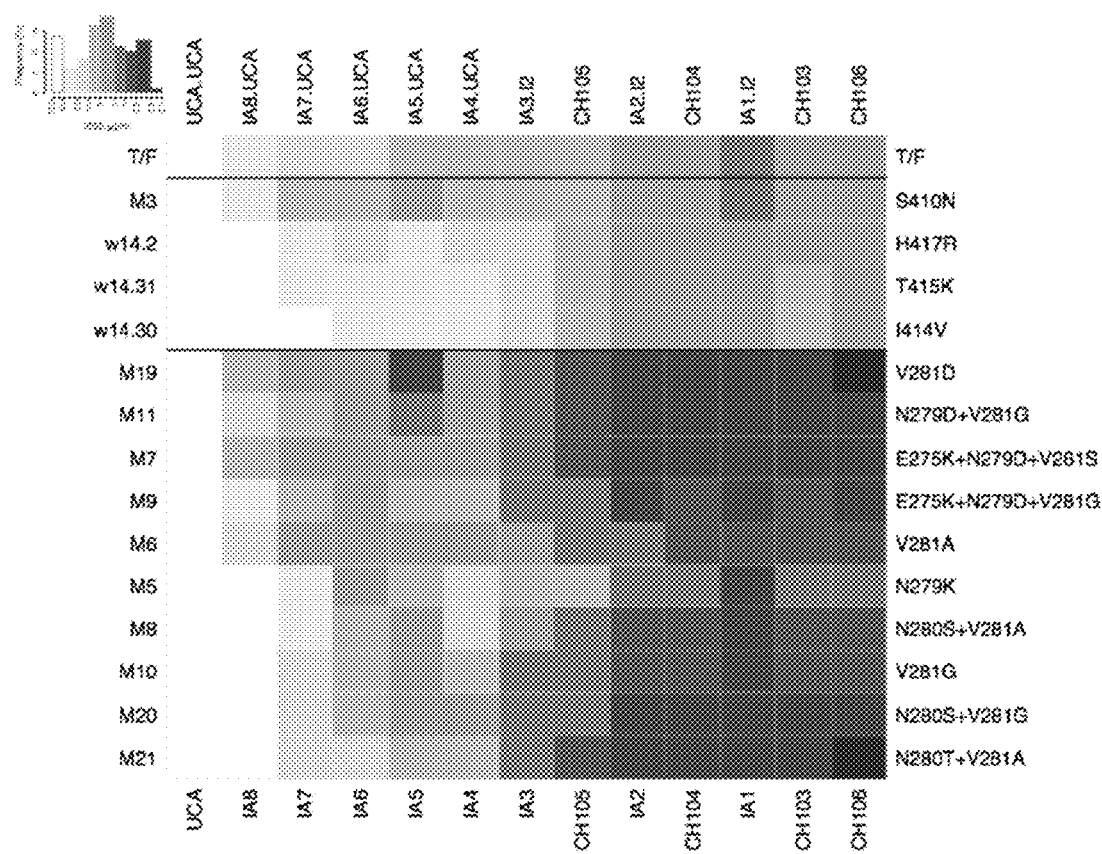
FIG. 29 is a heatmap showing neutralization potency of antibodies in the CH103 lineage against early CH505 mutations, evaluated by Feng Gao. M11 shows enhanced sensitivity relative to the TF, so might serve as a good trigger of the CH103 like lineage.
Figure 30:
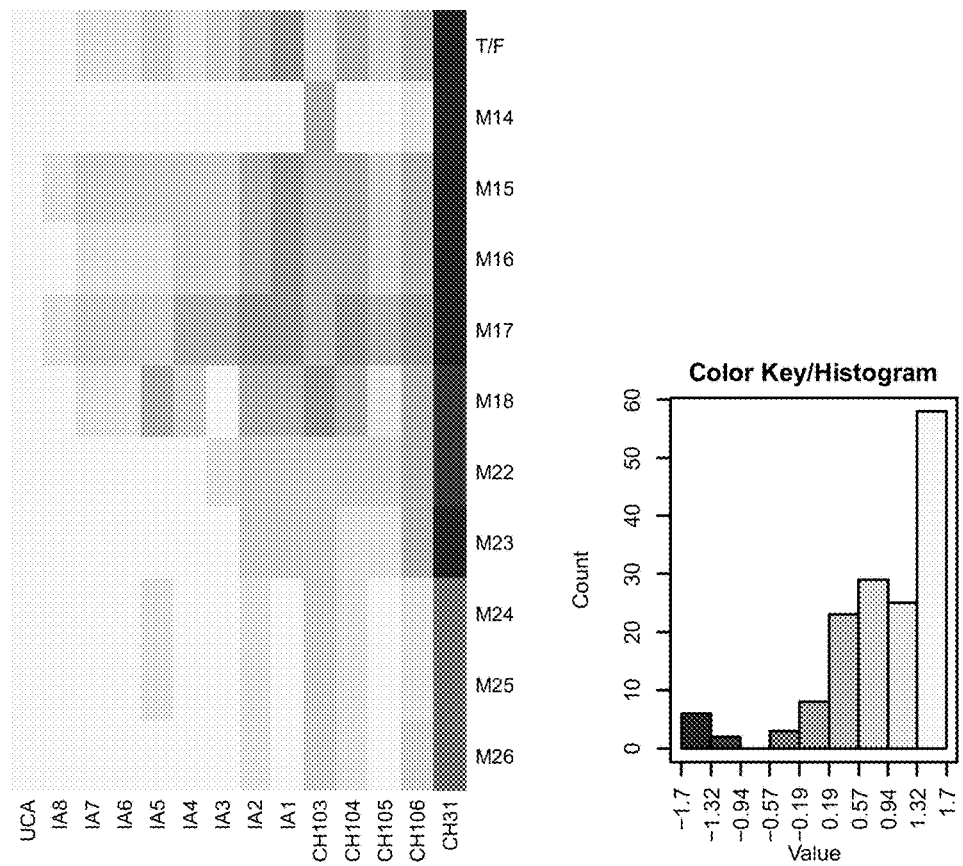
FIG. 30 shows a heatmap showing neutralization potency of antibodies in the CH103 lineage against population signature mutations. M14 confers partial resistance on its own, while the others need to be given in combination to confer resistance. In certain embodiments, adding M14 and M24 after affinity maturation is initiated may expand breadth.

M11 is a mutant generated to include two mutations in the loop D (N279D+V281G relative to the TF sequence) that enhanced binding to the CH103 lineage (see FIG. 29). These were early escape mutations for another CD4bs autologous neutralizing antibody lineage, but might have served to promote early expansion of the CH103 lineage.

In certain embodiments, the two CH103 resistance signature-mutation sequences added to the antigenic swarm are: M14 (TF with S364P), and M24 (TF with S375H+T202K+L520F +G459E) (See FIG. 30). They confer partial resistance to the TF with respect to the CH103 lineage. In certain embodiments, these D-loop mutants are administered in the boost.

In certain embodiments, two additional CH505 variants, w078.7 & w100.A4, are added to the selections to extend to further extend the sampling of the antigenic profile.

Example 3

Immunization protocols in subjects with swarms of HIV-1 envelopes

Immunization protocols contemplated by the invention include envelopes sequences as described herein including but not limited to nucleic acids and/or amino acid sequences of gp160s, gp150s, gp145, cleaved and uncleaved gp140s, gp120s, gp41s, N-terminal deletion variants as described herein, cleavage resistant variants as described herein, or codon optimized sequences thereof. A skilled artisan can readily modify the gp160 and gp120 sequences described herein to obtain these envelope variants. The swarm immunization protocols can be administered in any subject, for example monkeys, mice, guinea pigs, or human subjects.

In non-limiting embodiments, the immunization includes a nucleic acid is administered as DNA, for example in a modified vaccinia vector (MVA). In non-limiting embodiments, the nucleic acids encode gp160 envelopes. In other embodiments, the nucleic acids encode gp120 envelopes. In other embodiments, the boost comprises a recombinant gp120 envelope. The vaccination protocols include envelopes formulated in a suitable carrier and/or adjuvant, for example but not limited to alum. In certain embodiments the immnuzations include a prime, as a nucleic acid or a recombinant protein, followed by a boost, as a nucleic acid or a recombinant protein. A skilled artisan can readily determine the number of boosts and intervals between boosts.

Table 4 shows a non-limiting example of an immunization protocol using a swarm of four HIV-1 envelopes

| Envelope | Prime | Boost(s) | Boost(s) | Boost(s) |
| --- | --- | --- | --- | --- |
| w004.03 | w004.03 as a nucleic acid e.g. DNA/MVA vector and/or protein | | | |
| w053.16 | | w053.16 as a nucleic acid e.g. DNA/MVA and/or protein | | |
| w078.33 | | | w078.33 as nucleic acid e.g. DNA/MVA and/or protein | |
| W100.B6 | | | | W100.B6 as nucleic acid e.g. DNA/MVA and/or protein |

Table 5 shows a non-limiting example of an immunization protocol using a swarm of four HIV-1 envelopes

| Envelope | Prime | Boost(s) | Boost(s) | Boost(s) |
| --- | --- | --- | --- | --- |
| w004.03 | w004.03 as a nucleic acid e.g. DNA/MVA vector and/or protein | w004.03 as a nucleic acid e.g. DNA/MVA and/or protein | w004.03 as nucleic acid e.g. DNA/MVA and/or protein | w004.03 as nucleic acid e.g. DNA/MVA and/or protein |
| w053.16 | | w053.16 as nucleic acid e.g. DNA/MVA and/or protein | w053.16 as nucleic acid e.g. DNA/MVA and/or protein | w053.16 as nucleic acid e.g. DNA/MVA and/or protein |
| w078.33 | | | w078.33 as nucleic acid eg. DNA/MVA and/or protein | w078.33 as nucleic acid eg. DNA/MVA and/or protein |
| W100.B6 | | | | W100.B6 as nucleic acid e.g. DNA/MVA and/or protein |

Table 6 shows a non-limiting example of immunization protocol using a swarm of ten HIV-1 envelopes

| Envelope | Prime | Boost(s) | Boost(s) | Boost(s) |
| --- | --- | --- | --- | --- |
| T/F or w004.03, and M11 | T/F or w004.03, and M11 as nucleic acids and/or protein | | | |
| w030.28 | | w030.28 as nucleic acid and/or protein | | |
| w053.16, w053.31, | | | w053.16, w053.31, | |

-continued

| Envelope | Prime | Boost(s) | Boost(s) | Boost(s) |
|---|---|---|---|---|
| w078.7, w078.15, and w078.33 | | w078.7, w078.15, and w078.33 as nucleic acids and/or protein | | |
| W100.A4, and W100.B6 | | | | W100.A4, and W100.B6 nucleic acids and/or protein |

Table 7 shows a non-limiting example of immunization protocol using a swarm of ten HIV-1 envelopes

| Envelope | Prime | Boost(s) | Boost(s) | Boost(s) |
|---|---|---|---|---|
| T/F or w004.03, and M11 | T/F or w004.03, and M11 as nucleic acids and/or protein | T/F or w004.03, and M11 as nucleic acids and/or protein | T/F or w004.03, and M11 as nucleic acids and/or protein | T/F or w004.03, and M11 as nucleic acids and/or protein |
| w030.28 | | w030.28 as nucleic acid and/or protein | w030.28 as nucleic acid and/or protein | w030.28 as nucleic acid and/or protein |
| w053.16, w053.31, w078.7, w078.15, and w078.33 | | | w053.16, w053.31, w078.7, w078.15, and w078.33 as nucleic acids and/or protein | w053.16, w053.31, w078.7, w078.15, and w078.33 as nucleic acids and/or protein |
| W100.A4, and W100.B6 | | | | W100.A4, and W100.B6 nucleic acids and/or protein |

Table 8 shows a non-limiting example of immunization protocol with a swarm of twelve HIV-1 envelopes

| Envelope | Prime | Boost(s) | Boost(s) | Boost(s) | Boost(s) |
|---|---|---|---|---|---|
| T/F or w004.03, and M11 | T/F or w004.03, and M11 as nucleic acids and/or protein | | | | |
| w014.12, w014.32 | | w014.12, w014.32 as nucleic acid and/or protein | | | |
| w030.28 | | | w030.28 as nucleic acid and/or protein | | |
| w053.16, w053.31, w078.7, w078.15, and w078.33 | | | | w053.16, w053.31, w078.7, w078.15, and w078.33 as nucleic acids and/or protein | |
| W100.A4, and W100.B6 | | | | | W100.A4, and W100.B6 nucleic acids and/or protein |

Table 9 shows a non-limiting example of immunization protocol with a swarm of twelve HIV-1 envelopes

| Envelope | Prime | Boost(s) | Boost(s) | Boost(s) | Boost(s) |
|---|---|---|---|---|---|
| T/F or w004.03, and M11 | T/F or w004.03, and M11 as nucleic acids and/or protein | T/F or w004.03, and M11 as nucleic acids and/or protein | T/F or w004.03, and M11 as nucleic acids and/or protein | T/F or w004.03, and M11 as nucleic acids and/or protein | T/F or w004.03, and M11 as nucleic acids and/or protein |
| w014.12, w014.32 | w014.12, w014.32 as nucleic acids and/or protein | w014.12, w014.32 as nucleic acids and/or protein | w014.12, w014.32 as nucleic acids and/or protein | w014.12, w014.32 as nucleic acids and/or protein | w014.12, w014.32 as nucleic acids and/or protein |
| w030.28 | | | w030.28 as nucleic acid and/or protein | w030.28 as nucleic acid and/or protein | w030.28 as nucleic acid and/or protein |
| w053.16, w053.31, w078.7, w078.15, and w078.33 | | | | w053.16, w053.31, w078.7, w078.15, and w078.33 as nucleic acids and/or protein | w053.31, w078.7, w078.15, and w078.33 as nucleic acids and/or protein |
| W100.A4, and W100.B6 | | | | | W100.A4, and W100.B6 nucleic acids and/or protein |

Table 10 shows a non-limiting example of an immunization protocol with HIV-1 envelopes.

| Envelope | Prime | Boost(s) | Boost(s) | Boost(s) | Boost(s) |
|---|---|---|---|---|---|
| w000.TF, w004.03, (optionally 004.26) M10, M11, M19, M20, M21, M5, M6, M7, M8, M9. | As nucleic acids and/or proteins | | | | |
| w014.10, w014.2, w014.21, w014.3, w014.32, w014.8; w020.3, w020.4, w020.7, w020.8, w020.9, w020.11, w020.13, w020.14, w020.15, w020.19, w020.22, w020.23, w020.24, w020.26 | | As nucleic acids and/or proteins | | | |
| w030.5, w030.6, w030.9, w030.10, w030.11, w030.13, w030.15, w030.17, w030.18, w030.19, w030.20, w030.21, w030.23, w030.25, w030.27, w030.28, w030.36 | | | As nucleic acids and/or proteins | | |
| w053.3, w053.6, w053.13, w053.16, w053.25, w053.29, w053.31, w078.1, w078.6, w078.7, w078.9, w078.10, w078.15, w078.17, w078.25, w078.33, w078.38 | | | | As nucleic acids and/or proteins | |
| w100.A3, w100.A4, w100.A6, w100.A10, w100.A12, w100.A13, w100.B2, w100.B4, w100.B6, w100.B7, w100.C7, w136.B2, w136.B3, w136.B4, w136.B5, w136.B8, w136.B10, w136.B12, w136.B18, w136.B20, w136.B27, w136.B29, w136.B36, w160.A1, | | | | | As nucleic acids and/or proteins |

-continued

| Envelope | Prime | Boost(s) | Boost(s) | Boost(s) |
|---|---|---|---|---|
| w160.C1, w160.C2, w160.C4, w160.C11, w160.C12, w160.C14, w160.D1, w160.D5, w160.T2, w160.T4 | | | | |

Table 11 shows a non-limiting example of immunization protocol using a swarm of HIV-1 envelopes. Optionally in certain embodiments the boosts include M14, and M24 as nucleic acids and/or protein.

| Envelope | Prime | Boost(s) | Boost(s) | Boost(s) |
|---|---|---|---|---|
| T/F or w004.03, and M11 (M14 and M24 optional) | T/F or w004.03, and M11, (optionally in certain embodiments M14, and M24) as nucleic acids and/or protein | | | |
| w030.28 | | w030.28 as nucleic acid and/or protein | | |
| w053.16, w053.31, w078.7, w078.15, and w078.33 | | | w053.16, w053.31, (w078.7 optional in certain embodiments), w078.15, and w078.33 as nucleic acids and/or protein | |
| W100.A4 (optional), and W100.B6 | | | | (W100.A4 optional in certain embodiments), and W100.B6 nucleic acids and/or protein |

Table 12 shows a non-limiting example of immunization protocol using a swarm of HIV-1 envelopes. Optionally in certain embodiments the boosts include M14, and M24 as nucleic acids and/or protein.

| Envelope | Prime | Boost(s) | Boost(s) | Boost(s) |
|---|---|---|---|---|
| T/F or w004.03, and M11 (M14 and M24 optional) | T/F or w004.03, and M11, (optionally in certain embodiments M14, and M24) as nucleic acids and/or protein | T/F or w004.03, and M11, (optionally in certain embodiments M14, and M24) as nucleic acids and/or protein | T/F or w004.03, and M11, (optionally in certain embodiments M14, and M24) as nucleic acids and/or protein | T/F or w004.03, and M11, (optionally in certain embodiments M14, and M24) as nucleic acids and/or protein |
| w030.28 | | w030.28 as nucleic acid and/or protein | w030.28 as nucleic acid and/or protein | w030.28 as nucleic acid and/or protein |
| w053.16, W053.31, w078.7, | | | w053.16, W053.31, (w078.7 | w053.16, W053.31, (w078.7 |

| Envelope | Prime | Boost(s) | Boost(s) | Boost(s) |
|---|---|---|---|---|
| w078.15, and w078.33 | | | optional in certain embodiments), w078.15, and w078.33 as nucleic acids and/or protein | optional in certain embodiments), w078.15, and w078.33 as nucleic acids and/or protein (W100.A4 optional in certain embodiments), and W100.B6 nucleic acids and/or protein |
| W100.A4 (optional), and W100.B6 | | | | |

In certain embodiments an immunization protocol could include the following: Prime with a bivalent or trivalent Gag mosaic (Gag1 and Gag 2, Gag 1, Gag 2 and Gag3) in a suitable vector, plus CH505 Transmitted/Founder Env gp120 or gp160 plus T/F Env protein. Boost #1 could be: Gag1 and Gag-2 in a suitable vector, plus CH505 Transmitted/Founder Env gp120 or gp160, plus Env week 53 in a suitable vector, plus T/F and week 53 Env proteins. Boost #2 could be: Gag1 and Gag-2 in a suitable vector, plusCH505 week 78, plus week 100 Env gp120 or gp160, plus week 78+week 100 Env proteins.

Example 4

Env mixtures of the CH505 virus induce the beginning of CD4 binding site BnAb lineages Groups of Rhesus Macaques are immunized with CH505 gp120 variants as recombinant gp120 proteins: T/F, w053.16, w078.33, and w100.B6. Group 1: CH505 T/F env gp120; Group 2: w053.16, Group 3: w078.33; Group 4: Sequential of 4 Env immunization: T/F, w053.16, w078.33, and w100.B6; Group 5: Additive T/F, T/F+w053.16, T/F+w053.16 +w078.33, T/F+w053.16+w078.33+w100.B6.

Figures 26A, 26B:
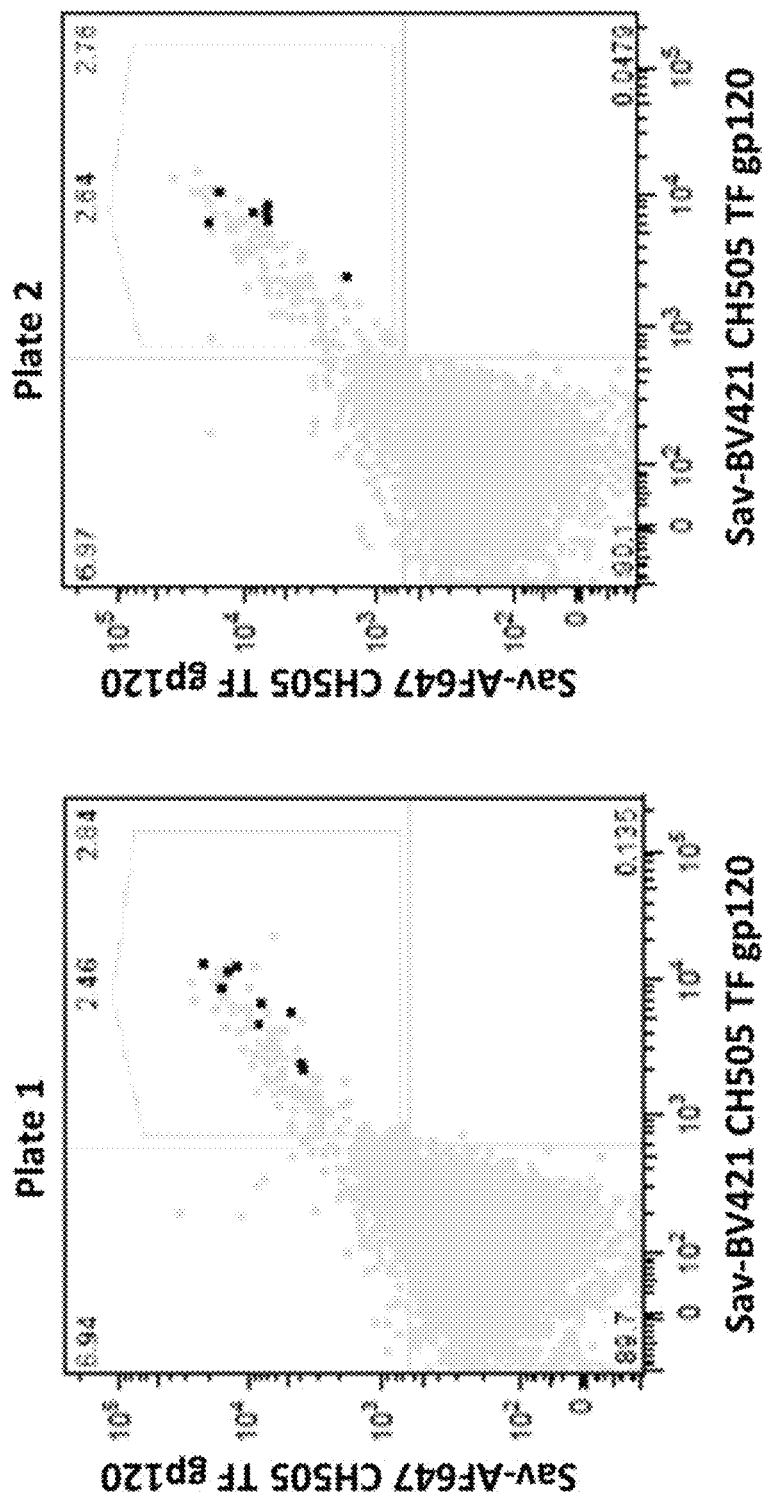
FIG. 26A shows CH505 TF gp120 DP=109; RSC3-positive (black DP)=10 (9%).
FIG. 26B shows CH505 TF gp120 DP=110; RSC3-positive (black DP)=8 (7%).
Figure 27:
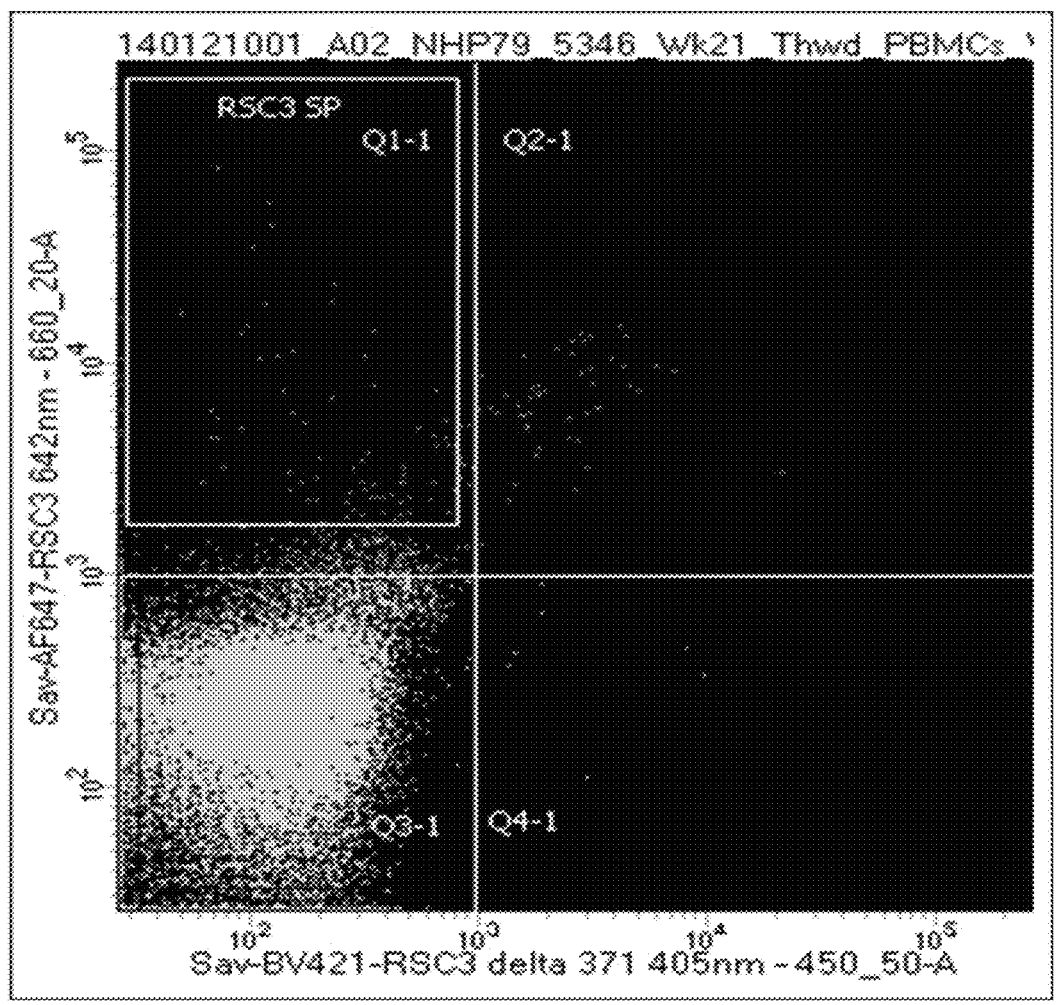
FIG. 27 shows RSC3+, RSC3D371-Memory B Cells in CH505 T/F Env-Immunized #79 NHPs. FACS analysis is carried out essentially as described in Example 1.

Immunizations are ongoing, with only three immunizations thus far with recombinant gp120 proteins. FIG. 26 shows interim results of one monkey from Group 1. FIGS. 26 and 27 show that three immunizations with CH505 T/F envelope stimulate reactive memory B cells which are RSC3 positive (bind the gp120 CH505 T/F envelope) and do not bind RSCD371 (indicative of CD4Binding Site bnAb antibodies).

Previous studies have shown evolution of BnAbs through autologous Nabs. For example, it was reported evolution of V3 glycan (PGT-like) antibodies by induction of autologous NAbs that drove T/F virus escape with appearance of N332 in escape mutants, that could drive N332-dependent BnAbs (Nature Med. 18: 1688, 2012). Liao et al. reported evolution of the CH103 lineage through autologous NAbs in the CH103 lineage (Nature 496: 469, 2013).

Two virus types were isolated from CH505 BnAb individual four weeks after transmission: the Transmitted/Founder virus and a variant termed week 004.3 (4.3). Transmitted/founder virus was the predominant virus quasispecies at week 4 (tier 2). One variant virus termed 4.3 is identical to the T/F virus except it has a mutation in the gp41 MPER of W680G, and it is more neutralization sensitive to the entire CH103 clonal lineage including being neutralized by the CH103 UCA (Tier 1b).

Figure 28:
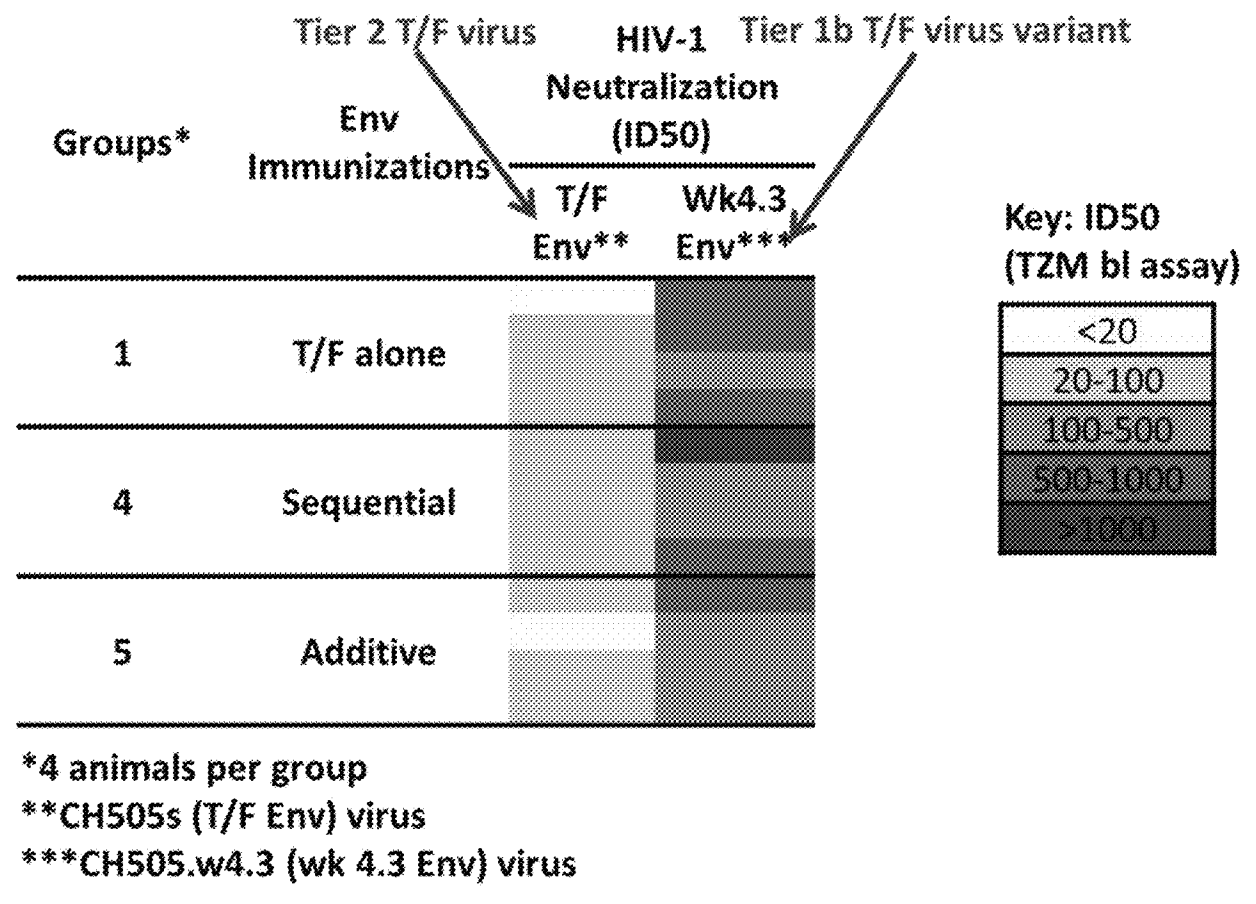

FIG. 28 shows induction of autologous neutralization of both the transmitted/founder CH505 Env and neutralization sensitive CH505 Env variant w004.3 in NHPs immunized with recombinant gp120 forms of either the transmitted/founder Env, week 53.16, week 78.33 or week 100.B6 in either group 1, T/F alone X3 or in sequence (Group 4) or additive sequence (Group 5) as in line 117 above. Shown is week 14 neutralization data after three immunizations recombinant gp120 proteins as describe above.

Following virus and antibody evolution is providing important insight into the sequence of virus Envs that induce broadly neutralizing antibodies. B cell lineage vaccine design is a strategy to target the unmutated common ancestors and their intermediates for selecting otherwise subdominant and unfavored lineages. Lineage design coupled with structural analysis of envelope-antibody co-crystals is providing a rational design of immunogens for pre-clinical immunization studies. This example demonstrated induction of autologous neutralizing antibodies of the CH103 lineage. Next steps are immunization of germline KI mouse models (CH103 GL on the way) and humans with the same immunogens.

Example 5

One of the major obstacles to developing an efficacious preventive HIV-1 vaccine is the challenge of inducing broadly neutralizing antibodies (bnAbs) against the virus. There are several reasons why eliciting bnAbs has been challenging and these include the conformational structure of the viral envelope, molecular mimicry of host antigens by conserved epitopes which may lead to the suppression of potentially useful antibody responses, and the high level of somatic mutations in the variable domains and the requirement for complex maturation pathways [1-3]. It has been shown that up to 25% of HIV-1—infected individuals develop bnAbs that are detected 2-4 years after infection. To date, all bnAbs have one or more of these unusual antibody traits: high levels of somatic mutation, autoreactivity with host antigens, and long heavy chain third complementarity determining regions (HCDR3s)—all traits that are controlled or modified by host immunoregulatory mechanisms. Thus, the hypothesis has been put forth that typical vaccinations of single primes and boosts will not suffice to be able to induce bnAbs; rather, it will take sequential immunizations with Env immunogens, perhaps over a prolonged period of time, to mimic bnAb induction in chronically infected individuals [4].

A process to circumvent host immunoregulatory mechanisms involved in control of bnAbs is termed B cell lineage immunogen design, wherein sequential Env immunogens are chosen that have high affinities for the B cell receptors of the unmutated common ancestor (UCA) or germline gene of the bnAb clonal lineage [4]. Envs for immunization can either be picked randomly for binding or selected, as described herein, from the evolutionary pathways of Envs that actually give rise to bnAbs in vivo. Liao and colleagues recently described the co-evolution of HIV-1 and a CD4 binding site bnAb from the time of seroconversion to the development of plasma bnAb induction, thereby presenting an opportunity to map out the pathways that lead to generation of this type of CD4 binding site bnAb [5]. They showed that the single transmitted/founder virus was able to bind to the bnAb UCA, and identified a series of evolved envelope proteins of the founder virus that were likely stimulators of the bnAb lineage. Thus, this work presents the HVTN with an opportunity to vaccinate with naturally-derived viral envelopes that could drive the desired B-cell responses and induce the development of broad and potent neutralizing antibodies. While the human antibody repertoire is diverse, it has been found that only a few types of B cell lineages can lead to bnAb development, and that these lineages are similar across a number of individuals [6,7]. Thus, it is feasible that use of Envs from one individual will generalize to others.

The approach in this concept sheet to address the challenge of eliciting broadly neutralizing antibodies in vaccinees involves selecting the Env immunogens, among multitude of diverse viruses that induced a CD4 binding site bnAb clonal lineage in an HIV-infected individual, by making sequential recombinant Envs from that individual and using these Envs for vaccination. The B-cell lineage vaccine strategy thus includes designing immunogens based on unmutated ancestors as well as intermediate ancestors of known bnAb lineages. A candidate vaccine could use transmitted/founder virus envelopes to, at first, stimulate the beginning stages of a bnAb lineage, and subsequently boost with evolved Env variants to recapitulate the high level of somatic mutation needed for affinity maturation and bnAb activity. The goal of such a strategy is to selectively drive desired bnAb pathways.

Liao et al demonstrated that in the CHAVI CH505 bnAb individual, the CH103 CD4 binding site bnAb lineage started with the lineage members first developing autologous neutralizing antibody activity, and then as the CH505 Env mutated, it developed bnAb activity. Thus, the first step of bnAb development is the development of the ability to neutralize the transmitted/founder virus.

The CH505 transmitted/founder (T/F) virus that we propose to use in Trial 1 in the concept has been tested in rhesus macaques; after 3 immunizations it induced plasma antibodies that neutralized the T/F virus and an early (week 4) T/F variant with only one mutation. In addition, flow phenotypic analysis of memory B cells in CH505 T/F Env-immunized rhesus macaques has demonstrated the presence of antigen-specific memory B cells that bind the Env protein RSC3 but not the RSC3 371 mutant protein [8], strongly indicating B cells that have begun a CD4 binding site bnAb lineage.

In certain embodiments, the CH505 virus used in Trial# 1 and Trial #2 is w004.03 instead of CH505 T/F.

Broadly neutralizing antibodies likely will not be induced by a single Env, and even a mixture of polyvalent random Envs (e.g. HVTN 505) is unlikely to induce bnAbs. Rather, immunogens must be designed to trigger the UCAs of bnAb lineages to undergo initial bnAb lineage maturation, and then use sequential immunogens to fully expand the desired lineages. The proposed trial will represent the first of many experimental clinical trials testing this concept in order to develop the optimal set of immunogens to drive multiple specificities of bnAbs. The HVTN will be at the cutting edge of this effort.

The concept is applicable to driving CD4 binding site lineage in multiple individuals due to the convergence of a few bnAb motifs among individuals. The adjuvant will be the GSK AS01E adjuvant containing MPL and QS21. Other suitable adjuvants can be used. This adjuvant has been shown by GSK to be as potent as the similar adjuvant AS01B but to be less reactogenic using HBsAg as vaccine antigen [Leroux-Roels et al., IABS Conference, April 2013, 9].

Trial #1 will involve 5 immunizations IM with the CH505 transmitted/founder (T/F) Env gp120 at months 0, 1, 3, 6 and 12 and evaluating different doses of protein. The follow up Trial #2 will have combinations of the T/F Env and week-53, week-78 and week-100 Env mutants. Because it takes over a year to develop bnAbs, the second trial will include the possibility of a month 18 boost as well.

This study aims to be the first of several iterative experimental phase I trials to test the ability of these Envs to initiate bnAb lineages, and to use the isolated B cells from the vaccinees to identify the lineages induced.

Hypotheses: The T/F vaccine strategy will be safe and well tolerated among HIV-uninfected individuals. The vaccine strategy will elicit HIV Env-specific binding antibodies in a dose-dependent manner. The vaccine will elicit autologous neutralizing antibodies to transmitted/founder viruses. The vaccine will induce CD4+ T cell responses. The vaccine will initiate CD4 binding site-specific-antibody lineages.

Proposed study

| Schema Trial #1 (Dose finding): T/F = transmitted/founder protein | | | | | | | |
|---|---|---|---|---|---|---|---|
| Study arm | N | Dose | Month 0 (Day 0) | Month 1 (Day 28) | Month 3 (Day 84) | Month 6 (Day 168) | Month 12 (Day 364) |
| Group 1 | 12 | 10 mcg | T/F | T/F | T/F | T/F | T/F |
| Group 2 | 12 | 20 mcg | T/F | T/F | T/F | T/F | T/F |
| Group 3 | 12 | 100 mcg | T/F | T/F | T/F | T/F | T/F |
| Group 4 | 6 | | placebo | placebo | placebo | placebo | placebo |
| Total | 42 (36/6) | | | | | | |

Products: CH505TF: HIV gp120 transmitted/founder with AS01E; Placebo for CH505TF: sodium chloride for injection Participants: 42 healthy, HIV-1-uninfected volunteers aged 18 to 50 years Number of participants: Total 42: 36 vaccine, 6 placebo Study duration: 18 months per participant [HVTN standard is 6 months after last vaccination.]

Objectives and endpoints

Primary objective 1: To evaluate the safety and tolerability of different doses of a prime-boost regimen of CH505TF vaccine in HIV-uninfected healthy adults Primary endpoint 1: Local and systemic reactogenicity signs and symptoms, laboratory measures of safety, and AEs and SAEs Primary objective 2: To evaluate binding antibody responses elicited by different doses of the CH505TF vaccine Primary endpoint 2: HIV-specific binding Ab responses as assessed by binding Ab multiplex assay two weeks after the fourth vaccination To determine the B cell repertoire of HIV-specific B cells To assess vaccine-induced follicular helper T cell (Tfh) responses Study design considerations Trial #1 is a dose finding trial to evaluate the safety and immunogenicity of the transmitted/founder gp120 protein, CH505TF. The first protocol will be used in establishing an IND. CH505TF will be available for clinical use approximately 6-7 months before additional three gp 120 proteins, representing variants from later timepoints in infection, are available. Assuming an acceptable safety and immunogenicity profile, trial #2 would follow with combinations of the T/F Env and week 53, 78 and 100 Env mutants. The doses for trial #2 will be informed by data from Trial #1. Because it takes over a year to develop bnAbs, the second trial will include the possibility of a month 18 boost as well. Combined, these studies will test the ability of these Envs to initiate bnAb lineages and to use the isolated B cells from the vaccinees to identify the lineages induced.

| Schema Trial #2 (Sequential doses) | | | | | | | |
|---|---|---|---|---|---|---|---|
| Study arm | N | Month 0 (Day 0) | Month 1 (Day 28) | Month 3 (Day 84) | Month 6 (Day 168) | Month 12 (Day 364) | Month 18 (Day 546) |
| Group 1 | 12 | 100 mcg T/F | 100 mcg 53 | 100 mcg 78 | 100 mcg 100 | 100 mcg Swarm | 100 mcg Swarm |
| Group 2 | 12 | 100 mcg T/F + 4 mg DNA mosaic | 100 mcg 53 + 4 mg DNA mosaic | 100 mcg 78 + 4 mg DNA mosaic | 100 mcg 100 + 4 mg DNA mosaic | 100 mcg Swarm | 100 mcg Swarm |
| Group 3 | 12 | 100 mcg T/F | 50 mcg T/F + 50 mcg 53 | 33 mcg T/F +33 mcg 53 +33 mcg 78 | 100 mcg Swarm | 100 mcg Swarm | 100 mcg Swarm |
| Group 4 | 12 | 100 mcg Swarm | 100 mcg Swarm | 100 mcg Swarm | 100 mcg Swarm | 100 mcg Swarm | 100 mcg Swarm |
| Group 5 | 12 | placebo | placebo | placebo | placebo | placebo | placebo |
| Total | 60 (48/12) | | | | | | |

Notes:
T/F = transmitted/founder protein;
Swarm = mixture of T/F, 53, 78, and 100; Example protein doses included, total actual dose to be informed by Trial #1

Secondary objective 1: To evaluate the ability of the regimen to elicit HIV-specific nAbs Secondary endpoint 1: nAb magnitude and breadth against autologous viral isolates as assessed by area under the magnitude-breadth curves two weeks after the fourth vaccination Secondary objective 2: To evaluate HIV-specific T-cell responses induced by different doses of the CH505TF vaccine Secondary endpoint 2: Response rate and magnitude of CD4+ T-cell responses as assessed by intracellular cytokine staining assays (ICS) two weeks after the fourth vaccination Exploratory objectives:

To further evaluate the immunogenicity of the vaccine regimen at different timepoints To isolate single B cells with desired specificities and determine lineage characteristics Products: CH505TF: transmitted/founder HIV gp120 with ASO1E; CH505w53.1: week 53 HIV gp120 with ASO1E; CH505w78.33: week 78 HIV gp120 with ASO1E; CH505w100.6: week 100 HIV gp120 with ASO 1E DNA Mosaic env: trivalent vaccine composed of mosaic HV13284, HV13285 and HV13286 that optimizes global coverage. All express gp160 Env protein. In certain embodiments, bivalent mosaic envelopes can be used. Placebo: sodium chloride for injection.

Statistical considerations

Accrual and sample size calculations: Recruitment into trial #1 will target 42 healthy, HIV-uninfected adults aged 18 to 50 years old at low risk of HIV infection in regions where clade B is the predominant clade. Enrollment will be concurrent with receiving the first study vaccination, thus all participants will provide some safety data. For immunogenicity analyses, however, it is possible that data may be missing for various reasons such as participants terminating from the study early, problems in shipping specimens, or low cell viability of processed peripheral blood mononuclear cells (PBMCs). Immunogenicity data from 11 phase 1 and 1 phase 2a HVTN trials, which began enrolling after June 2005 (data as of June 2011), indicate that 10% is a reasonable estimate for the rate of missing data. For this reason, the sample size calculations below account for 10% of enrolled participants having missing data for the primary immunogenicity endpoint.

Sample size calculations for safety: The ability of the study to identify SAEs can be expressed by the true event rate above which at least 1 event would likely be observed and the true event rate below which no events would likely be observed. Specifically, in each vaccine arm of the study (n=12), there is a 90% chance of observing at least 1 event if the true rate of such an event is 17.5% or more; and there is a 90% chance of observing no events if the true rate is 0.8% or less. In all vaccine arms of the study combined (n=36), there is a 90% chance of observing at least 1 event if the true rate of such an event is 6.2% or more; and there is a 90% chance of observing no events if the true rate is 0.2% or less.

Sample size calculations for immunogenicity: To address antibody endpoints, the analysis will descriptively summarize binding response positivity call rates and test superiority of the magnitude and breadth of the IgG binding Ab response to a panel of gp120 proteins for each of two comparisons (Group 1 vs 2, Group 2 vs 3), using a two-sided Wilcoxon rank sum test with 2.5% type-I error rate per comparison. The sample size of 12 vaccinees per group will give 80% power to detect a true difference of 1.82 standard deviations (SDs) between the mean non-zero responses and 90% power to detect a true difference of 2.04 SDs. These calculations assume a 10% loss-to-follow-up rate and the (94%) response rate observed in the HVTN 088 vaccine recipients. The same approach will be used to test superiority of the magnitude of the IgG binding Ab response to each individual gp120 antigen in the panel.

References

1. Mascola J R, Haynes B F. HIV-1 neutralizing antibodies: understanding nature's pathways. Immunol Rev 2013; 254:225-44.

2. Verkoczy L, Kelsoe G, Moody M A, Haynes B F. Role of immune mechanisms in induction of HIV-1 broadly neutralizing antibodies. Curr Opin Immunol 2011; 23:383-90.

3. Verkoczy L, Chen Y, Zhang J, Bouton-Verville H, Newman A, Lockwood B, Scearce R M, Montefiori D C, Dennison S M, Xia S M, Hwang K K, Liao H X, Alam S M, Haynes B F. Induction of HIV-1 broad neutralizing antibodies in 2F5 knock-in mice: selection against membrane proximal external region-associated autoreactivity limits T-dependent responses. J Immunol 2013; 191:2538-50.

4. Haynes B F, Kelsoe G, Harrison S C, Kepler T B. B-cell-lineage immunogen design in vaccine development with HIV-1 as a case study. Nat Biotechnol 2012; 30:423-33.

5. Liao H X, Lynch R, Zhou T, Gao F, Alam S M, Boyd S D, Fire A Z, Roskin K M, Schramm C A, Zhang Z, Zhu J, Shapiro L, Mullikin J C, Gnanakaran S, Hraber P, Wiehe K, Kelsoe G, Yang G, Xia S M, Montefiori D C, Parks R, Lloyd K E, Scearce R M, Soderberg K A, Cohen M, Kamanga G, Louder M K, Tran L M, Chen Y, Cai F, Chen S, Moquin S, Du X, Joyce M G, Srivatsan S, Zhang B, Zheng A, Shaw G M, Hahn B H, Kepler T B, Korber B T, Kwong P D, Mascola J R, Haynes B F. Co-evolution of a broadly neutralizing HIV-1 antibody and founder virus. Nature 2013; 496:469-76.

6. Morris L, Chen X, Alam M, Tomaras G, Zhang R, Marshall D J, Chen B, Parks R, Foulger A, Jaeger F, Donathan M, Bilska M, Gray E S, Abdool Karim S S, Kepler T B, Whitesides J, Montefiori D, Moody M A, Liao H X, Haynes B F. Isolation of a human anti-HIV gp41 membrane proximal region neutralizing antibody by antigen-specific single B cell sorting. PLoS One 2011; 6:e23532.

7. Zhou T, Zhu J, Wu X, Moquin S, Zhang B, Acharya P, Georgiev I S, Altae-Tran H R, Chuang G Y, Joyce M G, Do K Y, Longo N S, Louder M K, Luongo T, McKee K, Schramm C A, Skinner J, Yang Y, Yang Z, Zhang Z, Zheng A, Bonsignori M, Haynes B F, Scheid J F, Nussenzweig M C, Simek M, Burton D R, Koff W C, Mullikin J C, Connors M, Shapiro L, Nabel G J, Mascola J R, Kwong P D. Multidonor analysis reveals structural elements, genetic determinants, and maturation pathway for HIV-1 neutralization by VRC01-class antibodies. Immunity 2013; 39:245-58.

8. Lynch R M, Tran L, Louder M K, Schmidt S D, Cohen M, Dersimonian R, Euler Z, Gray E S, Abdool K S, Kirchherr J, Montefiori D C, Sibeko S, Soderberg K, Tomaras G, Yang Z Y, Nabel G J, Schuitemaker H, Morris L, Haynes B F, Mascola J R. The Development of CD4 Binding Site Antibodies During HIV-1 Infection. J Virol 2012; 86:7588-95.

9. Leroux-Roels I, Koutsoukos M, Clement F, Steyaert S, Janssens M, Bourguignon P, Cohen K, Altfeld M, Vandepapeliere P, Pedneault L, McNally L, Leroux-Roels G, Voss G. Strong and persistent CD4+T-cell response in healthy adults immunized with a candidate HIV-1 vaccine containing gp120, Nef and Tat antigens formulated in three Adjuvant Systems. Vaccine 2010; 28:7016-24.

Example 6

DNA and mRNA vaccination for mimicking HIV envelope evolution during broad neutralizing antibody induction In certain aspects the invention provides compositions and methods for HIV-1 vaccine development: DNA and RNA delivery system (for example but not limited by the Nanotaxi® nanoparticle delivery technology), as well as the B Cell Lineage Vaccine Design concept. This example will study the hypothesis that the critical factor for generation of broadly neutralizing antibodies (bnAbs) is exposure of the B cell repertoire to swarms of Env mutants that have developed over time such that the B cells induced both retain the ability to neutralize swarms of autologous viruses, while acquiring the ability to neutralize heterologous viruses.

B Cell lineage vaccine design concepts envision multiple immunogens to target the unmutated common ancestors (UAs) and intermediate antibodies (IAs) of clonal lineages of potentially protective antibodies to induce these UAs to begin maturation to generate protective antibody responses. Translational studies aimed at testing such concepts are required; however, the key would be to select appropriate immunogens that can be easily delivered either as a mix or in sequential manner and to determine the appropriate frequency of administrations. Nanotaxi®-based immunogens allows for easy handling and manipulations for such a complex set of vaccine immunogens.

The example will use the new CH505 set of T/F and sequential evolved Env envelopes (in certain embodiments the set includes 103/104 envelopes—Table 14) that gave rise to the CH103 bNAb lineage to generated broadly neutralizing CD4 binding site (bs) bnAb responses. In certain embodiment, w004.03 envelope is used instead of CH505 T/F envelope. In certain embodiments, D-loop mutants are optionally included. The CH505 set of Envs is derived from the CHAVI bnAb individual, CH505 who is one of the CHAVI001 cohort of Africans who were followed from the time of acute HIV infection to the development of high titers of bnAbs. CH505 plasma neutralizing activity and resulting CH103 lineage bnAbs are targeted to the CD4 binding site (Nature 496: 469, 2013). A series of evolved viruses were chosen which will be tested as either mRNAs or DNAs, for example but not limited administered by the Nanotaxi® technology.

Once synthesized, the Nanotaxi® immunogens will be fully characterized as chemical entities using existing analytical approaches. Physico-chemical analyses will be performed by Nuclear Magnetic Resonance (NMR), Mass Spectrometry (MS) and High-Performance Liquid Chromatography (HPLC) to ensure both the identity and the purity of the compounds. Once the Nanotaxi® are prepared, they will be formulated with DNA and mRNA, following a self-assembling process. The formulation will in turn be characterized, in terms of size and zeta potential of the complexed Nanotaxi®.

Stage 1. Comparison of the immunogenicity of DNAs vs. mRNAs expressed in Nanotaxi® formulation. For this comparison, we will make 4 sequential CH505 Envs as DNA vs mRNA gp120s and gp160s in the presence or in the absence of an immunostimulatory sequence (IS) linked to the CH505 env genes and then formulate them with Nanotaxi® and test their immunogenicity in C57BL6 mice for their ability to induce anti-Env antibodies. Each of the 4 Envs will be tested both alone as a prime-boost injection model, and with recombinant protein administered either as a boost or co-administered with the DNA or mRNA. In certain embodiments gp145 is used instead of gp160.

Below is a list of groups to be tested:

Groups 1, 2, 3 and 4—Immunization with each gp120 DNA formulated with Nanotaxi® X4.

Groups 5, 6, 7 and 8—Immunization with each gp120-IS DNA formulated with Nanotaxi® X4.

Groups 9, 10, 11 and12—Immunization with each gp160 DNA formulated with Nanotaxi® X4.

Groups 13, 14, 15 and 16—Immunization with each gp160-IS formulated with DNA Nanotaxi® X4.

Groups 17, 18, 19 and 20—Immunization with each gp120 mRNA formulated with Nanotaxi® X4.

Groups 21, 22, 23, and 24—Immunization with each gp120-IS mRNA formulated with Nanotaxi® X4.

Groups 25, 26, 27 and 28—Immunization with each gp160 mRNA formulated with Nanotaxi® X4.

Groups 29, 30, 31 and 32—Immunization with each gp160-IS mRNA formulated with Nanotaxi® X4.

Groups 33, 34, 35 and 36—Immunization with each Env gp120 protein alone X4

Groups 37, 38, 39 and 40—Immunization with each Env gp140 protein alone X4

Groups 41, 42, 43 and 44—Immunization with each Env as optimal genetic form from studies above (mRNA vs. DNA with or without the immunostimulatory sequence (IS); gp120 vs. gp160) in sequential format.

Groups 45, 46, 47 and 48—Immunization with each Env as optimal genetic form from studies above (mRNA vs. DNA with or without the immunostimulatory sequence(IS); gp120 vs. gp160) in sequential format, combined with four homologous Envs as proteins—delivered simultaneously with mRNA or DNAs.

All immunizations will be performed intramuscularly (IM) with 6 C57BL6 mice per group. Mouse immunizations will be followed for induction of titers of CH505 Env antibodies by ELISA. Other suitable non-human animal models can be used.

Once comparisons are made per above, a series of comparisons will be made of the optimal genetic immunizations given IM alone vs IM with Nanotaxi® as follows to ensure that Nanotaxi® is the optimal administration mode.

Group 49—Immunization with DNA or mRNA alone IM X4

Group 50—Immunization with DNA or mRNA formulated with Nanotaxi® IM X4.

Stage 2. Study of the immunogenicity of the optimized DNA or mRNA CH505 gp160 or gp120 Envs formulated with Nanotaxi® in CD4 binding site CH103 germline knockin mice and rhesus macaques. Here we will take the most immunogenic form of genetic immunization from Stage 1 and formulate 100 sequential evolved Envs for administration in the following manner:

For CH103 germline knockin mice:

Group 1 Immunization with DNA or mRNA formulated with Nanotaxi® with CH505 transmitted/founder (T/F) Env first, followed by a mixture of the next Envs, followed by a mixture of the next 33 Envs, followed by a mixture of the final Envs. Loop D mutants could be included in either prime and/or boost.

Group 2 Immunization with DNA or mRNA formulated with Nanotaxi® with CH505 transmitted/founder (T/F) Env first, followed by a mixture of the next 32 Envs, followed by a mixture of the next 33 Envs, followed by a mixture of the final 33 Envs. Here the genetic immunization will be the same as in group 1 except each immunization will be accompanied by 4 (T/F, week 53, week 78, week 100) CH505 Env protein as gp120s.

For Rhesus Macaques (NHP study #79)

Key is to determine how long it is necessary to immunize and what a precise regimen might be regarding sequential, additive or swarm types if immunizations. NHP study #79 is already ongoing and can inform the work by determining how long immunizations are needed and also by providing a protein only control set of experiments.

NHP #79 is divided into 6 groups (4 animals per group) as follows:

Group 1. Immunization with the Transmitted/Founder Env gp120 alone X5; last immunization finished 11/21/13; induced autologous (CH505 T/F) neutralizing antibodies (slides 1 and 2 above) ; animals now being studied for VH and VL lineages induced. Once autologous Nabs isolated, plans are next to boost with "swarm" of all 4 Envs.

Group 2. Immunization with second Env (week 53) only X5.

Group 3. Immunization with third Env (week 78) only X5.

Group 4. Immunization with sequential T/F, then week 53, then week 78, then week 100 Env, then a swarm of all 4 was completed; induced autologous Neutralizing antibodies of CH505 founder virus (FIGS. 26-29); animals now being studied for VH and VL lineage induced.

Group 5. Immunization with additive Envs (T/F first then T/F+53; then T/F+53+78; then T/F+53+78+100) then swarm of all 4 ; last immunization finished 11/21/13; induced autologous neutralizing antibodies; animals now being studied for VH and VL lineages induced.

Group 6. Immunization with fourth Env (week 100) only X5.

It took ~90 weeks for heterologous nAbs to appear in the CH505 plasma, and it took ~136 weeks for full bnAb activity to appear. Thus, a major way the NHP #79 study can inform the future studies to project how long and how many immunizations will be needed using genetic immunization.

Secondly, a key protocol to evaluate is the contribution of protein to genetic immunization when proteins are added to mRNA or DNA immunizations. We believe that that the most effective way to immunize will likely be the simultaneous combination of nucleotides in Nanotaxi® plus proteins. Thus, the NHP #79 studies probe the route and use of proteins alone.

NHP Study for testing of genetic immunization of swarms of Envs in rhesus macaques.

Group 1 Immunization with DNA or mRNA formulated with Nanotaxi® with CH505 transmitted/founder (T/F) Env first, followed by a mixture of the next Envs, followed by a mixture of the next Envs, followed by a mixture of the final Envs.

Group 2 Immunization with DNA or mRNA formulated with Nanotaxi® with CH505 transmitted/founder (T/F) Env first, followed by a mixture of the next Envs, followed by a mixture of the next Envs, followed by a mixture of the final Envs. Here the genetic immunization will be the same as in group 1 except each immunization will be accompanied by 4 (T/F, week 53, week 78, week 100) CH505 Env protein as gp120s.

All immunizations will be performed IM with 6 rhesus macaques per group. Immunizations will continue for 2.5 years in the rhesus macaques. NHP immunizations will be followed for induction of titers of CH505 Env antibodies, and the repertoire of clonal lineages of antibodies induced will be determined by a) memory B cell sorts using the CH505 gp120 as a fluorophor-labeled "hook", b) clonal memory B cell cultures with screening for single cells producing bnAbs, c) Atreca Inc. (Immune Repertoire Capture™ technology) screens of extent of clonal diversity using either plasma cells or memory B cells sorts with maintenance of VH and VL natural pairs, and d) Illumina MiSeq analysis of clonal expansions in NHPs with the vaccinations.

In addition, we will genetic immunizations in two types of humanized mice: the KYMAB® lambda mice (CH103 utilizes Vλ3-1) and our CH103 knockin mice that only express the germline VH4-59 and V13-1 genes of CH103 lineage. The latter mice will test the integrity of the Env immunogens for triggering of the CH103 lineage in the absence of germinal center competition for space by other clones, and the KYMAB® lambda mice will test the immunogens in a wildtype repertoire system much as in the rhesus macaques.

For both mouse lines, we will test 12 mice per group and the mode of monitoring the response will be identical to that in rhesus macaques.

Each of the models above has their advantages and disadvantages.

The CH103 GL mouse has the advantage of being able to see exactly what the CH505 immunogens can do for the CH103 lineage. The disadvantage is that the T cells are mouse and the Ig repertoire is human.

The KYMAB lambda mouse has the advantage of having the entire VH and Vlambda human repertoire and has the disadvantage of having mouse T helper cells and TFH.

The rhesus has the advantage of being primate and being most similar to human in repertoire and TFH cells with the disadvantage of cost and not being human. Nonetheless, the rhesus macaque for these immunogenicity studies is most like human of all the models and if our strategy works in rhesus macaques, we believe this is the best indicator that it will work in humans.

Stage 3. GMP Production of the 100 "Swarm" of CH505 Evolved Envs As Either DNAs or mRNAs (Downselected from Stage 1 above).

This stage of the project will consist in producing by subcontracting with a GMP manufacturer of plasmid DNA or mRNA molecules depending on the selected format. Subcontractors have already been identified by the members of the present proposal. Discussion with manufacturers will aim to define the timelines and the cost for the production of the 100 "swarm" of CH505 Evolved Env as DNAs or mRNAs. For proteins, the CH505 T/F, week 53, week 78 and week 100 gp120 Envs are already produced in bulk under GMP conditions for use in Phase I clinical trials, and these Envs will be available to for use with genetic immunization in Phase 1 trials should the genetic immunizations as "swarms" be successful in CH103 knockin mice and/or rhesus macaques.

Milestones

Stage 1. Decide on mRNA vs DNA regarding optimal immunogenicity in C57BL/6 mice. Criteria for deciding will be based on titers of CH505 Env antibodies in mouse plasma.

Stage 2. Criteria for proceeding to GMP DNA or mRNA production with Nanotaxi® formulation will be the demonstration in the CH103 bnAb germline knockin mice of the DNA or mRNA/NanoTaxi® formulation to induce clonal lineages of VH4-59—the VH of the CH103 lineage, or Vλ3-1, or induce any clonal lineages with binding to RSC3 protein but not to the RSC3 protein with an isoleucine deleted at position 371 (signifying a CD4 binding site BnAb lineage).

Similarly, criteria for proceeding to GMP DNA or mRNA production with Nanotaxi® formulation in KYMAB lambda mice and rhesus macaques will be for the DNA or mRNA/NanoTaxi® formulation to induce clonal lineages of the orthologues of VH4-59—the VH of the CH103 lineage, or orthologues of Vλ3-1, or induce any clonal lineages with binding to RSC3 protein but not to the RSC3 protein with an isoleucine deleted at position 371 (signifying a CD4 binding site BnAb lineage).

Thus, if either the right lineages are induced in the CH103 germline knockin mouse model or in KYMAB lambda mice or in rhesus macaques, we will move forward to GMP production. We will have this very high bar as a go-no go decision, since moving to stage 3 will be relatively expensive. That is to say, we will need to know our immunogens are inducing the correct lineages prior to moving to Stage 3.

Stage 3. Criteria for moving to a Phase I clinical trial will be the above immunogenicity in rhesus macaques, and the ability to scale up and produce the 100 Envs as DNAs or RNAs with NanoTaxi®.

SEQUENCE LISTING (665 sequences)

SEQ ID NO: 1 - DNA, 9699 bp, Artificial Sequence
  Description of Artificial Sequence: Synthetic polynucleotide
tggaagggttagtttactccaagaaaagacaagagatccttgatttgtgggtctataacacacaaggcttcttccctgattggcaaaactacacaccgggaccaggggtcagatatccactgacctttggatggtgcttcaagctagtgccagtcgatccagaggaagtagaagaggccaataaaggagaaaacaactgcttactacaccctatgagccagcatggaatggatgatgaggacagagaagtactaaagtggaagtttgacagtcagctagcacgcagacacatggcccgcgagctacatccggagtggtacaaagactgctgacacagaagggactttccgctgggactttccactggggcgttccagggggagtggtctgggcgggactgggagtggccaaccctcagatgctgcatataagcagctgcttttcgcctgtactgggtctctctaggtagaccagatctgagcccgggagctctctgactacctagggaacccactgcttaagcctcaataaaagcttgccttgagtgctctaagtagtgtgtgcccgtctgttgtgtgactctggtaactagagatccctcagaccctttgtggtagtgtggaaaatctctagcagtggcgcccgaacagggacttgaaagcgaaagtagaaccagaggagatctctcgacgcaggactcggcttgctgaagtgcactcggcaagaggcgagagcggcggctggtgagtacgccaaattttatttgactagcggaggctagaaggagagagatgggtgcgagagcgtcaatattaagagggggaaaattagataaatgggaaagaattaggttaaggccagggggaaagaaatgctatatgataaaacacttagtatgggcaagcagggagttggaaagatttgcacttaatcctggcctcttagaaacatcagaaggctgtagacaaataataaagcagctacaaccatctcttcagacaggaacagaggaacttagatcattatataacacagtagtaactctctattgtgtacatgaagagatagaagtacgagacaccaaagaagccttagacaaactagaggaagaacaaaacaaatgtcagcaaaaagcacagcaagcagaggcggctgacaaaggaaaggtcagccaaaattatcctatagtacagaatctccaagggcaaatggtacaccagcccctatcacctagaactttgaatgcatgggtgaaagtaatagaagagaagggttttaacccagaggtaatacccatgttttcagcattatcagaaggagccaccccacaagacttaaacaccatgttaaatacagtagggggacatcaagcagccatgcaaatgttgaaagataccatcaatgaggaggctgcagaatgggatagattacatccagtccatgcagggcctattgcaccaggccaaatgagagaaccaaggggaagtgatatagcaggaacaactagcaaccttcaggaacaaatagcatggatgacagctaacccacctatcccagtgggagaattgtataaaagatggataattctgggattaaataaaatagtaagaatgtatagccctgtcagcattttggacataaaacaagggccaaaagaaccctttagagactatgtagaccggttctttaaaactttgagagctgaacaagctacacaagatgtaaaaaattggatgacagacaccttgttgacccaaaatgcgaacccagattgtaagaccattttaagagcattaggaccaggggctacattagaagaaatgatgacagcatgccaaggagtgggaggacctagccacaaagcaagagtgctagctgaagcaatgagccaagtaaatcatccaaacataatgatgcagagaaacaattttaaaggaccaaaaagaattgttaaatgcttcaactgtggcaaggaagggcacatagccagaaattgcagggcacctaggaaaaggggctgttggaaatgtggaaaggaaggacaccaaatgaaagactgtactgaaaggcaggctaattttttagggaaaatttggccttcccacaaggggaggccagggaatttcatccagaacaggctagagcccacagccccaccagcagagagtttcaggttcgaggagacaacccccagtctgaagcaggagccgaaggagagggaaccacccttaacttccctcaaatcactctttggcagcgaccccttgtctcaataagagtagggggccagataaaggaggctctcttagacacaggagcagatgatacagtattagaagaaataaatttgccagggaaatggaaaccaaaaatgataggaggaattggaggctttatcaaagtaagacagtatgatcaaatatctatagaaatttgtggaaaaaaggctataggtacagtattagtgggacctacacctgtcaacataattggaaggaatctgttgactcagcttggatgtacattaaattttccaattagtcccattgaaactgtaccagtaaaattaaagccaggaatggatggcccaaaagttaaacaatggccattgacagaagagaaaataaaagcattaacagcaatctgtgaagacatggagaaggaaggaaaaatttcaaaaattgggcctgaaaatccatataacactccagtatttgccataaaaaagaaggacagtacaaagtggagaaaattagtagatttcagggaactcaacaagagaactcaagacttctgggaagttcaactaggaataccacacccagcagggttaaaaaagaaaaaatcagtgacagtactagatgtgggggatgcatatttttcagtacctttagatgaaggcttcaggaaatatactgcgttcaccatacctagtataaacaatgaaacaccagggattagatatcaatataatgtgcttccacagggatggaaaggatcaccagcaatattccagagtagcatgacaaaaatcttagagccctttaggataaaaaatccagacatagttatctatcaatatatggatgacttgtatgtaggatctgacttagaattaggacagcatagagcaaaaatagaagagctaagggaacatttattaaaatggggacttaccacaccagacaagaaacatcaaaaagaacccccatttctttggatggggtatgaactccatcctgacaaatggacagtacagcctataaagctgccagacaaggaaagctggactgtcaatgatatacaaaagttagtaggaaaattaaactgggcaagtcagatttacccagggattaaagtaaggcaactctgtaaactccttaggggggccaaagcactaacagacatagtaccactaactgaagaagcagaattagaattggcagagaacagggaaattctaaaagaaccagtacatggagtatattatgaccctgctaaagaattaatagctgaaatacagaagcaggggcatgaccaatggacataccaaatttaccaagaaccattcaaaaatctgaaaacaggaaagtatgcaaaaatgagggctgcccataccaatgatgtaaagcaattaacagaggcagtgcaaaaaatagctacagaaagcatagtaatatggggaaagacccctaagtttagattacccatccaaaaagaaacatgggagacatggtggacagactattggcaggctacctggattcctgagtgggagtatgttaatactcctcccctagtaaaattatggtaccaactggaaaaagaacccatagtaggagtagaaactttctatgtagatggagcagctaatagggaaactaagttaggaaaagcagggtatgttactgacaggggaaggcagaaagtcgtttccctaactgaaacaacaaatcagaaggctgagttacaagcaattcagttagctttgcaggattcaggatcagaagtaaacatagtaacagactcacagtatgcattaggaatcattcaagcacaaccagataagagtgaatcagggttagttaaccaaataatagaacagttaataaacaaggaaagaatctacctgtcatgggtaccagcacataagggaattggagggaatgaacaagtggacaaattagtaagtaaggggatcaggaaagtgctgtttctagatggaatagagaaggctcaagaagagcatgaaagatatcacaacaattggagagcaatggctagtgagtttaatctgccacccatagtagcaaaagaaatagtagctagctgtgataaatgtcagttaaaaggggaagccatacatggacaagtagactgtagtccagggatatggcaattagactgcacacatttagaaggaaaaactatcttggtagcagtccatgtagccagtggctacatagaagcagaggtcattccagcagaaacaggacaagaaacagcatactatatactaaaattagcaggaagatggccagtcaaaatgatacatacagacaatggcagtaatttcaccagtgctgcagttaaggcagcctgttggtgggcgggtatccaacaggaatttggaattccctacaatccccaaagtcagggagtagtagaatccatgaataaagaattaaagaaaatcatagggcaagtaagagatcaagctgagcaccttaagacagcagtacaaatggcagtattcattcacaattttaaaagaaaaggggggattggggggtacagtgcaggggaaagaataatagacatgatagcaacagacatacaaactaaagaattacaaaaacaaattataaaaattcaaaattttcgggtttattacagagacagcagagatcctatttggaaaggaccagccaaactactctggaaaggtgaaggggcagtagtcatacaagataacagtgacataaaggtagtaccaagaaggaaagtaaaaatcattagggactatggaaaacagatggcaggtgctgattgtgtggcaggtagacaggatgaggattagaacatggcacagtttagtaaagcaccacatgtatgtctcaaggagagctagtggatggttctacagacctcattatgcaagtagacatccaaaaataagttcagaggtacacatcccattaggggaggctagattagtaataacaacatattggggtttgcaaacaggagaaagagagtggcacttaggtaatggagcctccatagaatggagaatgagaaaatatagcacacaaatagatcctggcctggcagaccagctaattcatatgcattattttgattgttttgcagactctgccataagaaaagccatattaggacatatagttatccctaggtgtgactatcaagcaggacataataaggtaggatctcttcaatacttggcactgacagcattgataaaaccaaaaaagagaaagccacctctgcctagtgttaagaaattagtagaggatagatggaacaacccccagaagaccaggggccgcagagggaaccatataacgagtggacactagaactcttagaggaactcaagcaggaagctgtcagacactttcctagaccatggctccatgcattaggacaacatatctatgatacctatggggatacttggacaggagttgaagctataataagaatacttcaacagttactgtttactcatttcagaattgggtgccaacatagcagaataggcattctgcgacagagaagagcaagaaatggagccagtagaccctaacctagagccctggaatcatccaggaagtcagcccaaaactccttgtaataagtgttattgtaagcgatgctgctatcattgtctagtttgctttcagacaaaaggcttaggcatttcccatggcaggaagaagcggagacagcgacgaagcgctcctccaagcagtgagaatcatcaaaatcctttatcaaagcagtgagtattcaataagcatatgtaatgtttgatttatatgcaagagtagattatagaataggagtaggagcattggcaatagcactaatcatagcaataatagtgtggaccatagtatatatagaatataggaaattagtaagacaaagaaaaatagaccagttaattaaaagaattagggaaagagcagaagacagtggcaatgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataaaatggggggcaagtggtcaaaaagcagtatagttggatggcctgatgtaagagaaagaataagaagaactgatccagcagcagagggagtaggagcagcatctcaagacttagatagacatggggcacttacaattaacaacacagccgccaataatgctgattgtgcctggctggaggcacaagaggaggagggagaagtaggctttccagtcagacctcaggtacctttaagaccaatgacttataaggaagcattcgacctcagcttctttttaaaagaaaaggggggactggaagggttagtttactccaagaaaagacaagagatccttgatttgtgggtctataacacacaaggcttcttccctgattggcaaaactacacaccgggaccaggggtcagatatccactgacctttggatggtgcttcaagctagtgccagtcgatccagaggaagtagaagaggccaataaaggagaaaacaactgcttactacaccctatgagccagcatggaatggatgatgaggacagagaagtactaaagtggaagtttgacagtcagctagcacgcagacacatggcccgcgagctacatccggagtggtacaaagactgctgacacagaagggactttccgctgggactttccactggggcgttccagggggagtggtctgggcgggactgggagtggccaaccctcagatgctgcatataagcagctgcttttcgcctgtactgggtctctctaggtagaccagatctgagcccgggagctctctgactacctagggaacccactgcttaagcctcaataaaagcttgccttgagtgctctaagtagtgtgtgcccgtctgttgtgtgactctggtaactagagatccctcagaccctttgtggtagtgtggaaaatctctagca

SEQ ID NO: 2 - DNA, 1485 bp, Artificial Sequence
  Description of Artificial Sequence: Synthetic polynucleotide
atgggtgcgagagcgtcaatattaagagggggaaaattagataaatgggaaagaattaggttaaggccagggggaaagaaatgctatatgataaaacacttagtatgggcaagcagggagttggaaagatttgcacttaatcctggcctcttagaaacatcagaaggctgtagacaaataataaagcagctacaaccatctcttcagacaggaacagaggaacttagatcattatataacacagtagtaactctctattgtgtacatgaagagatagaagtacgagacaccaaagaagccttagacaaactagaggaagaacaaaacaaatgtcagcaaaaagcacagcaagcagaggcggctgacaaaggaaaggtcagccaaaattatcctatagtacagaatctccaagggcaaatggtacaccagcccctatcacctagaactttgaatgcatgggtgaaagtaatagaagagaagggttttaacccagaggtaatacccatgttttcagcattatcagaaggagccaccccacaagacttaaacaccatgttaaatacagtagggggacatcaagcagccatgcaaatgttgaaagataccatcaatgaggaggctgcagaatgggatagattacatccagtccatgcagggcctattgcaccaggccaaatgagagaaccaaggggaagtgatatagcaggaacaactagcaaccttcaggaacaaatagcatggatgacagctaacccacctatcccagtgggagaattgtataaaagatggataattctgggattaaataaaatagtaagaatgtatagccctgtcagcattttggacataaaacaagggccaaaagaaccctttagagactatgtagaccggttctttaaaactttgagagctgaacaagctacacaagatgtaaaaaattggatgacagacaccttgttgacccaaaatgcgaacccagattgtaagaccattttaagagcattaggaccaggggctacattagaagaaatgatgacagcatgccaaggagtgggaggacctagccacaaagcaagagtgctagctgaagcaatgagccaagtaaatcatccaaacataatgatgcagagaaacaattttaaaggaccaaaaagaattgttaaatgcttcaactgtggcaaggaagggcacatagccagaaattgcagggcacctaggaaaaggggctgttggaaatgtggaaaggaaggacaccaaatgaaagactgtactgaaaggcaggctaattttttagggaaaatttggccttcccacaaggggaggccagggaatttcatccagaacaggctagagcccacagccccaccagcagagagtttcaggttcgaggagacaacccccagtctgaagcaggagccgaaggagagggaaccacccttaacttccctcaaatcactctttggcagcgaccccttgtctcaataa

SEQ ID NO: 3 - DNA, 3003 bp, Artificial Sequence
  Description of Artificial Sequence: Synthetic polynucleotide
ttttttagggaaaatttggccttcccacaaggggaggccagggaatttcatccagaacaggctagagcccacagccccaccagcagagagtttcaggttcgaggagacaacccccagtctgaagcaggagccgaaggagagggaaccacccttaacttccctcaaatcactctttggcagcgaccccttgtctcaataagagtagggggccagataaaggaggctctcttagacacaggagcagatgatacagtattagaagaaataaatttgccagggaaatggaaaccaaaaatgataggaggaattggaggctttatcaaagtaagacagtatgatcaaatatctatagaaatttgtggaaaaaaggctataggtacagtattagtgggacctacacctgtcaacataattggaaggaatctgttgactcagcttggatgtacattaaattttccaattagtcccattgaaactgtaccagtaaaattaaagccaggaatggatggcccaaaagttaaacaatggccattgacagaagagaaaataaaagcattaacagcaatctgtgaagacatggagaaggaaggaaaaatttcaaaaattgggcctgaaaatccatataacactccagtatttgccataaaaaagaaggacagtacaaagtggagaaaattagtagatttcagggaactcaacaagagaactcaagacttctgggaagttcaactaggaataccacacccagcagggttaaaaaagaaaaaatcagtgacagtactagatgtgggggatgcatatttttcagtacctttagatgaaggcttcaggaaatatactgcgttcaccatacctagtataaacaatgaaacaccagggattagatatcaatataatgtgcttccacagggatggaaaggatcaccagcaatattccagagtagcatgacaaaaatcttagagccctttaggataaaaaatccagacatagttatctatcaatatatggatgacttgtatgtaggatctgacttagaattaggacagcatagagcaaaaatagaagagctaagggaacatttattaaaatggggacttaccacaccagacaagaaacatcaaaaagaacccccatttctttggatggggtatgaactccatcctgacaaatggacagtacagcctataaagctgccagacaaggaaagctggactgtcaatgatatacaaaagttagtaggaaaattaaactgggcaagtcagatttacccagggattaaagtaaggcaactctgtaaactccttaggggggccaaagcactaacagacatagtaccactaactgaagaagcagaattagaattggcagagaacagggaaattctaaaagaaccagtacatggagtatattatgaccctgctaaagaattaatagctgaaatacagaagcaggggcatgaccaatggacataccaaatttaccaagaaccattcaaaaatctgaaaacaggaaagtatgcaaaaatgagggctgcccataccaatgatgtaaagcaattaacagaggcagtgcaaaaaatagctacagaaagcatagtaatatggggaaagacccctaagtttagattacccatccaaaaagaaacatgggagacatggtggacagactattggcaggctacctggattcctgagtgggagtatgttaatactcctcccctagtaaaattatggtaccaactggaaaaagaacccatagtaggagtagaaactttctatgtagatggagcagctaatagggaaactaagttaggaaaagcagggtatgttactgacaggggaaggcagaaagtcgtttccctaactgaaacaacaaatcagaaggctgagttacaagcaattcagttagctttgcaggattcaggatcagaagtaaacatagtaacagactcacagtatgcattaggaatcattcaagcacaaccagataagagtgaatcagggttagttaaccaaataatagaacagttaataaacaaggaaagaatctacctgtcatgggtaccagcacataagggaattggagggaatgaacaagtggacaaattagtaagtaaggggatcaggaaagtgctgtttctagatggaatagagaaggctcaagaagagcatgaaagatatcacaacaattggagagcaatggctagtgagtttaatctgccacccatagtagcaaaagaaatagtagctagctgtgataaatgtcagttaaaaggggaagccatacatggacaagtagactgtagtccagggatatggcaattagactgcacacatttagaaggaaaaactatcttggtagcagtccatgtagccagtggctacatagaagcagaggtcattccagcagaaacaggacaagaaacagcatactatatactaaaattagcaggaagatggccagtcaaaatgatacatacagacaatggcagtaatttcaccagtgctgcagttaaggcagcctgttggtgggcgggtatccaacaggaatttggaattccctacaatccccaaagtcagggagtagtagaatccatgaataaagaattaaagaaaatcatagggcaagtaagagatcaagctgagcaccttaagacagcagtacaaatggcagtattcattcacaattttaaaagaaaaggggggattggggggtacagtgcaggggaaagaataatagacatgatagcaacagacatacaaactaaagaattacaaaaacaaattataaaaattcaaaattttcgggtttattacagagacagcagagatcctatttggaaaggaccagccaaactactctggaaaggtgaaggggcagtagtcatacaagataacagtgacataaaggtagtaccaagaaggaaagtaaaaatcattagggactatggaaaacagatggcaggtgctgattgtgtggcaggtagacaggatgaggattag

SEQ ID NO: 4 - DNA, 579 bp, Artificial Sequence
  Description of Artificial Sequence: Synthetic polynucleotide
atggaaaacagatggcaggtgctgattgtgtggcaggtagacaggatgaggattagaacatggcacagtttagtaaagcaccacatgtatgtctcaaggagagctagtggatggttctacagacctcattatgcaagtagacatccaaaaataagttcagaggtacacatcccattaggggaggctagattagtaataacaacatattggggtttgcaaacaggagaaagagagtggcacttaggtaatggagcctccatagaatggagaatgagaaaatatagcacacaaatagatcctggcctggcagaccagctaattcatatgcattattttgattgttttgcagactctgccataagaaaagccatattaggacatatagttatccctaggtgtgactatcaagcaggacataataaggtaggatctcttcaatacttggcactgacagcattgataaaaccaaaaaagagaaagccacctctgcctagtgttaagaaattagtagaggatagatggaacaacccccagaagaccaggggccgcagagggaaccatataacgagtggacactag

SEQ ID NO: 5 - DNA, 291 bp, Artificial Sequence
  Description of Artificial Sequence: Synthetic polynucleotide
atggaacaacccccagaagaccaggggccgcagagggaaccatataacgagtggacactagaactcttagaggaactcaagcaggaagctgtcagacactttcctagaccatggctccatgcattaggacaacatatctatgatacctatggggatacttggacaggagttgaagctataataagaatacttcaacagttactgtttactcatttcagaattgggtgccaacatagcagaataggcattctgcgacagagaagagcaagaaatggagccagtagaccctaa

SEQ ID NO: 6 - DNA, 306 bp, Artificial Sequence
  Description of Artificial Sequence: Synthetic polynucleotide
atggagccagtagaccctaacctagagccctggaatcatccaggaagtcagcccaaaactccttgtaataagtgttattgtaagcgatgctgctatcattgtctagtttgctttcagacaaaaggcttaggcatttcccatggcaggaagaagcggagacagcgacgaagcgctcctccaagcagtgagaatcatcaaaatcctttatcaaagcaacccttatcccaagcccgaggggaccagacaggcccggaggaatcgaagaagaaggtggagagcaagacagaaacagatcaacgcgattag

SEQ ID NO: 7 - DNA, 372 bp, Artificial Sequence
  Description of Artificial Sequence: Synthetic polynucleotide
atggcaggaagaagcggagacagcgacgaagcgctcctccaagcagtgagaatcatcaaaatcctttatcaaagcaacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggag

SEQ ID NO: 8 - DNA, 261 bp, Artificial Sequence
  Description of Artificial Sequence: Synthetic polynucleotide
atgtttgatttatatgcaagagtagattatagaataggagtaggagcattggcaatagcactaatcatagcaataatagtgtggaccatagtatatatagaatataggaaattagtaagacaaagaaaaatagaccagttaattaaaagaattagggaaagagcagaagacagtggcaatgagagtgatggggatacagaggaattatccacaatggtggatatggagcatgttaggcttttggatgctaatgatttgtaa

SEQ ID NO: 9 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 10 - DNA, 624 bp, Artificial Sequence
  Description of Artificial Sequence: Synthetic polynucleotide
atggggggcaagtggtcaaaaagcagtatagttggatggcctgatgtaagagaaagaataagaagaactgatccagcagcagagggagtaggagcagcatctcaagacttagatagacatggggcacttacaattaacaacacagccgccaataatgctgattgtgcctggctggaggcacaagaggaggagggagaagtaggctttccagtcagacctcaggtacctttaagaccaatgacttataaggaagcattcgacctcagcttctttttaaaagaaaaggggggactggaagggttagtttactccaagaaaagacaagagatccttgatttgtgggtctataacacacaaggcttcttccctgattggcaaaactacacaccgggaccaggggtcagatatccactgacctttggatggtgcttcaagctagtgccagtcgatccagaggaagtagaagaggccaataaaggagaaaacaactgcttactacaccctatgagccagcatggaatggatgatgaggacagagaagtactaaagtggaagtttgacagtcagctagcacgcagacacatggcccgcgagctacatccggagtggtacaaagactgctga

SEQ ID NO: 11 - DNA, 2541 bp, Artificial Sequence; identical to SEQ ID NO: 9
  Description of Artificial Sequence: Synthetic polynucleotide

SEQ ID NO: 12 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacgcatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctggggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 13 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgtaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 14 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 15 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgtgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctaaaatttgtattaggaatttgtagagctatccgaaacatacctacaagaataagacagggctttgaaacagctttgctataa

SEQ ID NO: 16 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattattaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggaaagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctaaaatttgtattaggaatttgtagagctatccgcaacatacctacaagaataagacagggctttgaaacagctttgctataa

SEQ ID NO: 17 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgccgtgctttcgttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 18 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaaaagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagacggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 19 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagagatggttttaaaaaatgtaacagaaaatttcaacatgtggaaaaatgacatggtggatcagatgcatgaagatgtaattagtttatgggatcaaagcctcaagccatgtgtaaagttgaccccactctgtatcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctatcggataccctagcaatagcagtaggtgaaggaacagataggattctagaatttgtattaggaatttgtagagctatccgcaacatacctacaagaataagacagggctttgaaacagctttgctataa

SEQ ID NO: 20 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactaccctattttgtgcatcagatgctaaagcatatgagaaagaagtgcataatgtctgggctacacatgcctgtgtacccacagaccccaatccacaagaaatgtttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagagaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagagcaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagcctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 21 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatatgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagttttaattgtggaggagaatttttctattgcaatacatcaagcctgtttaataggacatatatggctaatagcacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagcagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 22 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctaatgccagcaataacagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcacattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 23 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatatcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagatataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 24 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccaacaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggaaacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaagaatttgtagagctatccgcaacatacctacaagaataagacagggctttgaaacagctttgctataa

SEQ ID NO: 25 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtacataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccaacaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggaaacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 26 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaataacagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagaaaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 27 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 28 - DNA, 2541 bp, Artificial Sequence
  Description of Artificial Sequence: Synthetic polynucleotide
atgagagtgatggggatacaaaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgttagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataagaaacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctagccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 29 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagaaaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcggggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaaatatctgggaagtcttgtgcagtattggggcctggaattaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 30 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagaaaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttggattcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 31 - DNA, 2538 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagaaaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggaaagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 32 - DNA, 2556 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttctactcaactattgttaaatggtagcctagcagaaggagagataataattagatctgaaaatataacaaacaatgtcaaaacaataatagtacatctcaatgaatctgtaaagattgagtgtacgagacccaataataaaacaagaaaaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 33 - DNA, 2556 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttctactcaactattgttaaatggtagcctagcagaaggagagataataattagatctgaaaatataacaaacaatgtcaaaacaataatagtacatctcaatgaatctgtaaagattgagtgtacgagacccaataataaaacaagaaaaagtataagaataggaccaggacaagcattttatgcaacaggacaagtaataggagacataagagaagcatattgtaacattaatgaaagtaaatggaatgaaactttacaaagggtaagtaaaaaattaaaagaatatttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 34 - DNA, 2562 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaataccaatgctactgccagcaatagcagtacaatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggaaacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatacagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagcaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 35 - DNA, 2527 bp, Artificial Sequence
  Description of Artificial Sequence: Synthetic polynucleotide
atgagagtgatggggatacagaggaattatccacaatggtggatatggagcatgttaggcttttggatgctaatgatttgtaaagggatgtgggtcacagtctactatggggtacctgtgtggaaagaagcaaaaactactctattttgtgcatcagatgctaaagcatatgagaaagaagtgcataatgtttgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatatcagtaatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacagacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcaataggtgaaggaacagataggattctagaatttgtattaggaatttgtagagctatccgcaacatacctacaagaataagacagggctttgaaacagctttgctataa

SEQ ID NO: 36 - DNA, 2574 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 37 - DNA, 2556 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgttactctaaactgtaccaatgctactaatgctactgccagcaatagcagtataatagagggaatgaaaaattgctctttcaatataaccacagaattaagagataagagagagaaaaagaatgcacttttttataaacttgatatagtacaactagatggcaactccagtcagtatagattaataaattgtaatacctcagtcataacacaagcctgtccaaaggtctcttttgacccaattcctatacattattgtgctccagctggttatgcgattctaaagtgtaataataagacattcactggaacaggatcgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccaataataaaacaagaacaagtataagaataggaccaggacaagcattttatgcaacaggacaagtaataggagacataaaagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaacatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcaataggtgaaggaacagataggattctagaatttgtattaggaatttgtagagctatccgcaacatacctacaagaataagacagggctttgaaacagctttgctataa

SEQ ID NO: 38 - DNA, 2559 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccagtaataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaagtattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaataacagtaggtgaaggaacagataggattctagaatttgtattaggaatttgtagagctatccgcaacatacctacaagaataagacagggctttgaaacagctttgctataa

SEQ ID NO: 39 - DNA, 2559 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgcacgagacccaataataaaacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacaatctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 40 - DNA, 2553 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccaatgctactgccagcaatagcagtataatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaattattgttaaatggtagcctagcagaaggagagataataattagatctgaaaatataacaaacactgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 41 - DNA, 2553 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccggctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatccggagacattcagacctggaggaggaaatatgaaggacaattggagaagtgaattatataaatataaagtggtagaagttaagccattaggagtagcacccactaatgcaagaaggagagtggtggagagagaaaaaagagcagtgggtttgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggttgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagtagtaggtgaaggaacagataggattctagaatttgtattaggaatttgtagagctatccgcaacatacctacaagaataagacagggctttgaaacagctttgctataa

SEQ ID NO: 42 - DNA, 2559 bp, Artificial Sequence
  Description of Artificial Sequence: Synthetic polynucleotide
atgagagtaatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgacccccctctgtgtcactctaaactgtaccaatgctactgccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgttagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcacattgtaacattagtgaaagtaaatggaataaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaagatgggaagcccttaagtatctgggaagtcttgtgcagtattggggcctggaactaaaaaggagtgctattagtctattggataccctagcaatagcaataggtgaaggaacagataggattctagaatttgtattaggaatttgtagagctatccgcaacatacctacaagaataagacagggctttgaaacagctttgctataa

SEQ ID NO: 43 - DNA, 2559 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgacccccctctgtgtcactctaaactgtaccaatgctactgccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggcttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 44 - DNA, 2559 bp, Artificial Sequence
  Description of Artificial Sequence: Synthetic polynucleotide
atgagagtgatggggatacagaggaattatccacaatggtggatatggagcatgttaggcttttggatgctaatgatttgtaacgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacaactcaatgaatctgtaaagattgagtgtacgagacccaataataaaacaagaacaagtataagaataggaccaggacaagcattttatgcaacaggacaagtaataggaaacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 45 - DNA, 2562 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggaaacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 46 - DNA, 2562 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatgctactgccagcaatagcagcataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccagtaataaaacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 47 - DNA, 2562 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatgggtttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcatcagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattacagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 48 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgacaaaacaataatagtacatctcaatgaatctgtaaagattgagtgtacgagacccaataataacacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagcgttgctataa

SEQ ID NO: 49 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagatgaccccactctgtgtcactctaaactgtaccaatgctactgccatcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgacaaaacaataatagtacatctcaatgaatctgtaaagattgagtgtacgagacccaataataaaacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttagaaagatacctaaaggatcaacagctcctagggatgtggggctgctctggaaaactcatctgcaccactaatgtatattggaactctagttggagtaataaaagttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 50 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagatgaccccactctgtgtcactctaaactgtaccaatgctactgccatcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgacaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacggaaactaacaatacacgacccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggaatagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttagaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 51 - DNA, 2565 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacagtggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcatcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaagtatcacaggactactattgacaagggatggaggagaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgttttctttagtaaatagagttaggcagggatactcacctctatcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 52 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacctactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggttgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 53 - DNA, 2547 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccgatgctactgccagcaatgctactgccatcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacagacccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaagaagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 54 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactttattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttaaccccactctgtgtcactctaaactgtaccaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtactcatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacaatacggagacattcgagacattcagacctggaggaggaaatatgaaggacaattggagaagtgaattatataaatataaagtggtagaagttaagccattaggagtagcacccactaatgcaagaaggagagcggtggagagagaaaaaagagcagtgggaatgggagctgtgttccttgggttcttaggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctaaaatttgtattaggaatttgtagagctatccgcaacatacctacaagaataagacagggctttgaaacagctttgctataa

SEQ ID NO: 55 - DNA, 2580 bp, Artificial Sequence
  Description of Artificial Sequence: Synthetic polynucleotide
atgagagtgatggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtagatcagatgcatgaagatgtaattagtttatgggatcaaagcctcaagccatgtgtaaagttgaccccactctgtgtcactctaaactgtaccgatgctactgccagcaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataacaagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaaataaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctctctttagtaaatagagttaggcagggatactcacctctgtcattgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgcattaggaatttgtagagctatccgcaacatacctacaagaataagacagggctttgaaacagctttgctataa

SEQ ID NO: 56 - DNA, 2553 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtagatcagatgcatgaagatgtaattagtttatgggatcaaagcctcaagccatgtgtaaagttgaccccactctgtgtcactctaaactgtaccgatgctactgccagcaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaaattacaacacatagttttaattgtggaggagaatttttctattgcaatacatcaagcctgtttaataggacatatatggctaatagtacagaaactaacagtacacgaatcatcacaatccgctgcagaataaaacaaattataaacatgtggcaggaggtgggaagagcaatgtatgcccctcccattgcaggaaacataacatgtatatcaaatatcacaggactactattgacaagggatggaggaaataacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctataggggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaatgatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctctctttagtaaatagagttaggcagggatactcacctctgtcattgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgcattaggaatttgtagagctatccgcaacatacctacaagaataagacagggctttgaaacagctttgctataa

SEQ ID NO: 57 - DNA, 2580 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctaatgctactgccagcaatagcagtataatagagggaatgaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaaggaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaactgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 58 - DNA, 2589 bp, Artificial Sequence
  Description of Artificial Sequence: Synthetic polynucleotide
atgagagtgatggggagacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccgatgctactgccagcaatgctactgccagcaatagcagtataatagagggaatgaatagtagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaacaggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcgattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 59 - DNA, 2580 bp, Artificial Sequence
  Description of Artificial Sequence: Synthetic polynucleotide
atgagagtgatggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctactgccagcaatgctactgccagcaatgctactgccagcaatagcagtatcaatagcagtataatagaggaaatgaaaaattgctctttcaatataaccacagaattaagagataagagagagaaaaagaatgcacttttttataaacttgatatagtacaactagatggcaactctagtcagtatagattaataaattgtaatacctcagccataacacaagcctgtccaaaggtatcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcataagaatataacatttcaaccatcctcaggaggggacctagaagttacaacacatagctttaattgtggaggagaatttttctattgcaatacatcaagcctgtttaataggacagatatggctaatagtacagaaactaacagtacacgaatcatcacaatccgctgcagaataaaacaaattgtaaacatgtggcaggaggtgggacgagcaatgtatgcccctcccattgcaggaaacataacatgtatatcaaatatcacaggactactattgacaagggatggaggagaaaacaatggaggaaaaaacaatacagagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgtaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctctctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 60 - DNA, 2598 bp, Artificial Sequence
  Description of Artificial Sequence: Synthetic polynucleotide
atgagagtgatggggagacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcacgccatgtgtaaagttgaccccactctgtgtcactctaaactgtaccgatgctactgccagcaatgctactgccagcaatgctactgccagcaatgctactgccagcaatagcagtataataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctaataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaatgatatatgaattgcttgaagaatcacaaaaccagcaggaaaagaatgaacaagatttactagcattggacagatggaacagtctgtggaattggtttaacataacaaagtggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggccgggaactaaaaaggagtgctattagtctattggataccctagcaatagcagtaggtgaaggaacagataggattctagaatttgcattaagaatttgtagagctatccgcaacatgcctacaagaataagacagggctttgaaacagctttgctataa

SEQ ID NO: 61 - DNA, 2592 bp, Artificial Sequence
  Description of Artificial Sequence: Synthetic polynucleotide
atgagagtgatggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtagatcagatgcatgaagatgtaattagtttatgggatcaaagcctcaagccatgtgtaaagttgaccccactctgtgtcactctaaactgtaccgatgctactgccagcaatgctactgccagcaatgctactgccagcaatgctactgccagcaatagcagtataataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcagaagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaatgatatatgaattgcttgaagaatcacaaaaccagcaggaaaagaatgaacaagatttactagcattggacagatggaacagtctgtggaattggtttaacataacaaagtggctgtggtatataaaaatattcataatgatagtaggaggcttgatatgtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgcattaggaatttgtagagctatccgcaacatacctacaagaataagacagggctttgaaacagctttgctataa

SEQ ID NO: 62 - DNA, 2547 bp, Artificial Sequence
  Description of Artificial Sequence: Synthetic polynucleotide
atgagagtgacggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcagatcagatgcatgaagatgtaattagtttatgggatcaaagcctcaagccatgtgtaaagttgaccccactctgtgtcactctaaactgtatcgatgccaatgctactgccagcaatgctactgccagcaatagcagtataatagagggaatgaaaaattgctctttcaatataaccacagaattaagagataagatagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacaaacagtgccaaaacaataatagtacatctcaatgaatctgtaaagattgagtgtacgagacccagtaataacacaagaacaagtataagaataggaccaggacaagcattttatgcaacaggacaagtaataggagacataagaaaagcacattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaataacaatactacggagacattcagacctggaggaggaaatatgaaggacaattggagaagtgaattatataaatataaagtggtagaaattaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcgattatacagaaataatatatgaattgcttgaagaatcacaaaaccagcaggaaaagaatgaacaagatttactagcattggacagatggaacagtctgtggaattggtttaacataacaaactggctgtggtatataaaaatattcataatgatagtaggaggcttgataggtttaagaataatttttgctgtgctttctttagtaaatagagttaggcagggatactcacctctgtcgttgcagacccttaccccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 63 - DNA, 2559 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaattttaacatgtggaaaaatgacatggtggatcagatgcatgaagatgtaattagtttatgggatcaaagcctcaagccatgtgtaaagttaaccccactctgtgtcactctagactgtatcaatgctactaatgctactgccagcaatagcagtatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtactcatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacctagaaattacaacacatagctttaattgtggaggagaatttttctattgcaatacatcaagcctgtttaataggacatatatggttaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 64 - DNA, 2559 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaggttgaccccactctgtgtcactctaaactgtatcaatgctactaatgctactgccagcaataacagtatattagagggaatgaaaaattgctctttcaatatagccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtaaaaaattaaaagaatacttccctgataagaatataacatttcaaccatcctcaggaggggacctagaaattacaacacatagctttagttgtggaggagaatttttctattgcaatacatcaagcctgtttaataggacatatatggctactaatacagatatggctaatagtacagaaactaacagtacacgaatcatcacaatccgctgcagaataagacaaattataaacatgtggcaggaggtgggacgagcaatgtatgcccctcccattgcaggaaacataacatgtatatcaaatatcacaggactactattgacaagggatggaggagaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 65 - DNA, 2550 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaagctgtaccaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacgatacggatacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaaatcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 66 - DNA, 2562 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcgatgctactgccagcaatgctactgccatcaatatcagtataatagaggaaatgaaaaattgctctttcaatataaccacagaattaagagataagagagagaaaaagaatgcacttttttataaacttgatatagtacaactagatggcaactctagtcagcatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 67 - DNA, 2562 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcgatgctactgccagcaatgctactgccatcaatatcagtataatagaggaaatgaaaaattgctctttcaatataaccacagaattaagagataagagagagaaaaagaatgcacttttttataaacttgatatagtacaactagatggcaactctagtcagcatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtaaaagtaaatggaatgaaactttacaaagggtaagtgaaaaattaaaagaatacttccctcataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaaaaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 68 - DNA, 2580 bp, Artificial Sequence
  Description of Artificial Sequence: Synthetic polynucleotide
atgagagtgatggggatacagaggaattatacacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgttaatgctactgccagcaatagcagtataatagagggaatgaatagcagtatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacaatacggagacattcgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtgggactggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 69 - DNA, 2553 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccatgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctcagaagaatataacatttcaaccatcctcaggaggggacctagaaattacaacacatagctttaattgtggaggagaatttttctattgcaatacatcaagcctgtttaatagaacatatatggctactagtacagatatggctaatagtacagaaactaacagtacacgaatcatcacaatccgctgcaggataaaacaaattataaacatgtggcaggaggtgggacgagcaatgtatgcccctcccattgcaggaaacataacatgtatatcaaatatcacaggactactattgacaagggatggaggaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 70 - DNA, 2553 bp, Artificial Sequence
  Description of Artificial Sequence: Synthetic polynucleotide
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaggttgaccccactctgtgtcactctaaactgtatcaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcaatatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacactccactgcagaataaaacaaattataaacatgtggcaggaggtgggacgagcaatgtatgcccctcccattgcaggaaatataacatgtatatcaaatatcacaggactactattgacaagggatggagggaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaactattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaaggaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 71 - DNA, 2556 bp, Artificial Sequence
  Description of Artificial Sequence: Synthetic polynucleotide
atgagagtgatggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaggttgaccccactctgtgtcactctaaactgtatcaatgctactaatgctactgccagcaatagcagtatattagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacgcatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaaatctgtttaataggacatatatggttaatagtacagatatggctaatagtacagaaactaacagtacacgaaccatcacaatcagctgcagaataaaacaaattataaacatgtggcaggaggtgggacgagcaatgtatgcccctcccattgcaggaaacataacatgtatatcaaatatcacaggactactattgacaagggatggaggaaaaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 72 - DNA, 2556 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccgatgctactaatgctactgccagcaatagcagtatattagggggaatgaaaaattgctctttcaatataaccacagaattaagagataagagagagaaaaagaatgcacttttttataaacttgatatagtacaactagatggcaactctagtcagtatagattaataaattgtaatacctcagccataacacaagcctgtccaaaggtctcttttgacccaattcctatacattattgcgctccagctggttatgcgattctaaagtgtaataataagacattcaatggaacaggaccatgtaataatgtcagcacagtacaatgtacacatggaattaagccagtggtttcaactcaactattgttaaatggtagcctagcagaaggagagataataattagatctaaaaacataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaatgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaactggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 73 - DNA, 2577 bp, Artificial Sequence
  Description of Artificial Sequence: Synthetic polynucleotide
atgagagtgatggggatacagaagaattgtccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtactgatgctaatgctactgccagcaatagcagtataataaagggaatgaatagcagtatgatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctcagaaagatataacatttcaaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggagaaaacgatacggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacagaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgaaagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 74 - DNA, 2571 bp, Artificial Sequence
  Description of Artificial Sequence: Synthetic polynucleotide
atgagagtgatggggatacagaggaattatccacaatggtggatatggagcatgttaggcttgtggatgctaatgatttgtaatgggatgtgggtcacagtctactatggggtacctgtgtggaaaaaagcaaaaactactctattttgtgcatcagatgctaaagcatatgagaaagaagtgcatagtgtctgggctacacatgcctgtgtacccacagaccccaatccacaagaaatggttttaaaaaatgtaacagaaaatttcaacatgtggaaaaatgacatggtagatcagatgcatgaagatgtaattagtttatgggatcaaagcctcaagccatgtgtaaagttgaccccactctgtgtcactctaaactgtaccgatgctaatgctactgccagcaatagcagtataataaagggaatgaatagcagtatgatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggcagcctagcagaaggagagataataattagatctgaaaatataacaaacagtgccaaaacaataatagtacatctcaatgaatctgtaaagattgagtgtacgagacccagtaataacacaagaacaagtataagaataggaccaggacaagcattttatgcaacaggacaagtaataggagacataagaaaagcacattgtaacattagtgaaagtaaatggaatgaaactttacaaagggtaagtaaaaaattaaaagaatacttccctgataggaatataacatttcaaccatcctcaggaggggacccagaaattacaacacatagctttaattgtggaggaaaatttttctattgcaatacatcaagcctgtttaatagaacatatatggctaatagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaataacaatacggagacattcagacctgtaggaggaaatatgaaggacaattggagaagtaaattatataaatataaagtggtagaagttaagccattaggagtagcacccactaaggcaagaaggagaatggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaaaaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagactttatattaattgcagcgagagcgggggaacttctgggacgcagcagtctcaagggactacggagaggatgggaagcccttaagtatctggaaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 75 - DNA, 2589 bp, Artificial Sequence
  Description of Artificial Sequence: Synthetic polynucleotide
atgagagtgatggggaggcagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtagatcagatgcatgaagatgtaattagtttatgggatcaaagcctcaagccatgtgtaaagttgaccccactctgtgtcactctaaactgtaccgatgctaatgctactgccagcaataccaatgctactgccagcaatatcaatgctactgccagcaagaacagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgaatgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaatcatcctcaggaggggacccagaaattacaacacatagctttaattgtggaggagaatttttctattgcaatacatcaagcctgtttaataggacatatatggctaatagtacagatatggctaatagtacagaaactaacagtacacgaatcatcacaatccgctgcagaataaaacaaattataaacatgtggcaggaggtgggacgagcaatgtatgcccctcccattgcaggaaacataacatgtatatcaaatatcacaggactactattgacaagggatggaggaaacagcagtacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatgatgatatttgggataacatgacctggatgcagtgggagagagaaattagcaattatacagaaatgatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtactttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtttattggataccctagcaatagcagtaggtgaaggaacagataggattctagaatttgtattaggaatttgtagagctatccgcaacatacctacaagaataagacagggctttgaaacagctttgctataa

SEQ ID NO: 76 - DNA, 2604 bp, Artificial Sequence
  Description of Artificial Sequence: Synthetic polynucleotide
atgagagtgatggggatacagaggaattatccacaatggtggatatggagcatgttaggcttgtggatgctaatgacttgtaatgggatgtgggtcacagtctactatggggtacctgtgtggaaagaagcaaaaactactctattttgtgcatcagatgctaaagcatatgagaaagaagtgcataatgtctgggccacacatgcctgtgtacccacagaccccaatccacaagaaatggttttaaaaaatgtaacagaaaatttcaacatgtgggaaaatgacatggtagatcagatgcatgaagatgtaattagtttatgggatcaaagcctcaagccatgtgtaaagttgaccccactctgtgtcactctaaactgtaccgatgctaatgctactgccagcaataccaatgctactgccagcaatatcaatgctactgccagcaagagcagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgaatgtacgagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaatcatcctcaggaggggacccagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggagaaaacaatggaggaaaaaacaatacagagacattcagacctggaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 77 - DNA, 2571 bp, Artificial Sequence
  Description of Artificial Sequence: Synthetic polynucleotide
acgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctaatgctactgccagcaatatcaatgctactgccagcaagagcagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatagcaaaacaataatagtacatctcaatgaatctgtaaagattgagtgtacaagacccagtaataacacaagaacaagtataagaataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggagaaaacacaagggatggaggaaataacaatacggagacattcagacctgaaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccaggcaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 78 - DNA, 2592 bp, Artificial Sequence
  Description of Artificial Sequence: Synthetic polynucleotide
atgaaagtgagggggatacagaggaattatccacaatggtggatatggagcatgttaggcttgtggatgctaatgatttgtaatgggatgtgggtcacagtctattatggggtacctgtgtggaaagaagcaaaaactactctattttgtgcatcagatgctaaagcatatgagaaagaagtgcataatgtctgggctacacatgcctgtgtacccacagaccccaatccacaagaaatggttttagaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctaatgctactgccagcaataccaatgctactgccagcaatatcaatgctactgccagcaagagcagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatagcaaaacaataatagtacatctcaatgaatctgtaaagattgagtgtacaagacccagtaataacacaagaacaagtataaggataggaccaggacaagcattttatgcaacaggacaagtaataggagacataagagaagcacattgtaacattagtgaaagtaaatggaatgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcagggaacataacatgtatatcaaatatcacaggactactattgacaagggatggaggagaaaacacaagggatggaggaaataacaatacggagacattcagacctgaaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 79 - DNA, 2592 bp, Artificial Sequence
  Description of Artificial Sequence: Synthetic polynucleotide
atgagagtgatggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagcgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctaaactgtaccgatgctaatgctactgccagcaatgctaatgctactgccagcaataccaatgctactgtcagcaatagcagtataatagaggaaatgaaaaattgctctttcaatataaccacagaattaagagataagagagagaaaaagtatgcacttttttataaacttgatatagtacaactagatggcaactctagtcagtatagattaataaattgtaatacctcagtcataacccaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactactgttaaatggtagcctagcagaaggagagataataattagatctgaaaatataacaaacagtgccaaaacaataatagtacatctcaatgaatctgtaaagattgagtgtacgagacccagtaataacacaagaacaagtataagaataggaccaggacaagcattttatgcaacaggacaagtaataggagacataagaaaagcacattgtaacattagtgaaagtaaatggaatgaaactttacaaagggtaagtaaaaaattaaaagaatacttccctcataagaatataacatttcaaccatcctcaggaggggacccagaaattacaacgcatagttttaattgtggaggagaatttttctattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggagaaaacacaagggatggaggaaataacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcatcaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacataatatatgacttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 80 - DNA, 2556 bp, Artificial Sequence
  Description of Artificial Sequence: Synthetic polynucleotide
atgagagtgatggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaattttaacatgtggaaaaatgacatggtggatcagatgcatgaagatgtaattagtttatgggatcaaagcctcaagccatgtgtaaagttgaccccactctgcgtcactctaagctgtatcaatgctactaatgctactgacagcaataacagtatattagagggaatgaaaaattgctctttcaatataaccacagaattaagagataagagagagaaaaagaatgcacttttttataaacttgatatagtacaactatatggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtactcatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatctagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatagtgatatttgggataacatgacctggatgcagtgggagagagaaattagcaattatacagacatgatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgggcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 81 - DNA, 2556 bp, Artificial Sequence
  Description of Artificial Sequence: Synthetic polynucleotide
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaattttaacatgtggaaaaatgacatggtggatcagatgcatgaagatgtaattagtttatgggatcaaagcctcaagccatgtgtaaagttgaccccactctgtgtcactctaaactgtatcaatgctactaatgctactgccagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacactccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatagtgatatttgggataacatgacctggatgcagtgggagagagaaattagcaattatacagacatgatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctggaacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacggctttgctataa

SEQ ID NO: 82 - DNA, 2556 bp, Artificial Sequence
  Description of Artificial Sequence: Synthetic polynucleotide
acgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggactgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaattaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 83 - DNA, 2556 bp, Artificial Sequence
  Description of Artificial Sequence: Synthetic polynucleotide
atgagagtgagggggatacagaggagttatccacaatggtggatatggagcatgttaggcttttggatgctaatgatttgtaatgggatgtgggtcacagtctattatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 84 - DNA, 2556 bp, Artificial Sequence
  Description of Artificial Sequence: Synthetic polynucleotide
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 85 - DNA, 2556 bp, Artificial Sequence
  Description of Artificial Sequence: Synthetic polynucleotide
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaatataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 86 - DNA, 2556 bp, Artificial Sequence
  Description of Artificial Sequence: Synthetic polynucleotide
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataaggcattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtacagatatggctaatagtacagaaactaacagtacacgaatcatcacaatccattgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgttataa

SEQ ID NO: 87 - DNA, 2556 bp, Artificial Sequence
  Description of Artificial Sequence: Synthetic polynucleotide
atgagagtgagggggatacagaggagttatccacaatggtggatatggagcatgttaggcttttggatgctaatgatttgtaatgggatgtgggtcacagtctactatggggtacctgtgtggagagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgacagcaatagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagataatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtaaaaaattaaaaaaatacttccctgataagaatataacatttcgaccatcctcaggaggggacctagaaattacaacacatagctttaattgtggaggagaatttttctattgcaatacatcaagcctgtttaataggacatatatggctactagtatagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaataaagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 88 - DNA, 2559 bp, Artificial Sequence
  Description of Artificial Sequence: Synthetic polynucleotide
atgagagtgatggggacacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggcggatcagatgcatgaagatgtaattagtttatgggatcaaagcctcaagccatgtgtaaagttgaccccactctgtgtcactctatactgtatcaatgctactgccaatgctactgtcagcaatagcagtataatagaggaaatgaaaaattgctctttcaatataaccacagaattaagagataagagagagaaaaagaatgcacttttttataaacttgatatagtacaactagatggcaactctagtcagtatagattaataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaacccaactattgttaaatggtagcctagcagaaggagagataataattagatctgaaaatataacaaacagtgccaaaacaataatagtacatctcaatgaatctgtaaagattgagtgtacgagacccagtaataacacaagaacaagtataagaataggaccaggacaagcattttatgcaacaggacaagtaataggagacataagacaagcacattgtaacattagtgaaagtaaatggaatgaaactttacaaagggtaagtgaaaaattaaaagaatacttccctaataagactataacatttcaaccatcctcaggaggggacccagaaattacaacacatagctttaattgtggaggagaatttttctattgcaatacatcaagcctgtttaataggacatatatggctaatagtacagatatggctaatagtacagaaactaacagtacacgaaccatcacactccactgcagaataaaacaaattataaacatgtggcaagaggtgggacgagcaatgtatgcccctcccattgcaggaaacataacatgtatatcaaatatcacaggactactattgacaagggatggaggaaacagcagtaaggagacagagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagacctaatatatgacttgcttgaagaatcacaaaaccagcaggaaaagaatgaacaagatttattagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcctctaccaccgattgagagacttcatattaattgcagcgagagcgggggaacttctgggacgcagcagtctcaagggactacggagagggtgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 89 - DNA, 2574 bp, Artificial Sequence
  Description of Artificial Sequence: Synthetic polynucleotide
atgagagtgagggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagcgcataatgtctgggctacacatgcctgtgtacccacagaccccaatccacaagaaatggttttaaaaaatgtaacagaaaatttcaacatgtgggaaaatgacatggtagatcagatgcatgaagatgtaattagtttatgggatcaaagcctcaagccatgtgtaaagttgaccccactctgtgtcactctaaactgtaccgatgctaatgctactgccagcaataccaatgctactgtcagcaatatcaaggctactgtcagcaatagcagtataatagaggaaatgaaaaattgctctttcaatataaccacagaattaagagataagatagagaaaaagtatgcacttttttataaacttgatatagtacaactagatggcaactctactcagtatagattcataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccggcaataacacaagaacaagtataagaataggaccaggacaagcattttatgcaacaggacaagtaataggagacataagacaagcacattgtaacattagtgaaagtaaatggaatgaaactttacaaagggtaagtgaaaaattaaaagaatacttccctaataagactataacatttcaaccatcctcaggaggggacccagaaattacaacacatagctttaattgtggaggagaatttttttattgcaatacatcaagcctgtttaataggacatacatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaacactacggatatagagacattcagacctggaggaggaaatatgaaggacaattggagaagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcgataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatgatgatatttgggataacatgacctggatgcagtgggagagagaaattagcaattacacagaaataatatatgacttgcttgaagaatcacaaaaccagcaggaaaagaatgaacaagatttactagcattggacaggtggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaggtattgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 90 - DNA, 2580 bp, Artificial Sequence
  Description of Artificial Sequence: Synthetic polynucleotide
atgagagtgagggggatacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagcgcataatgtctgggctacacatgcctgtgtacccacagaccccaatccacaagaaatggttttaaaaaatgtaacagaaaatttcaacatgtgggaaaatgacatggtagatcagatgcatgaagatgtaattagtttatgggatcaaagcctcaagccatgtgtaaagttgaccccactctgtgtcactctaaactgtaccgatgctaatgctactgccagcaatgctaatgctactgccagcaataccaatgctactgtcagcaatgatagcagtataatagaggaaatgaaaaattgctctttcaatataaccacagaattaagagataagatagagaaaaagtatgcacttttttataaacttgatatagtacaactagatggcaactctactcagtatagattcataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaacataacagacaatggcaacacaataatagtacatctcaatgaatctgtaaagattgagtgtacgagacccagtaataacacaagaacaagtataagaataggaccaggacaagcattttatgcaacaggacaagtaataggagacataagacaagcacattgtaacattagtgaaagtaaatggaatgaaactttacaaagggtaagtgaaaaattaaaagaatacttccctgataagaatataacatttcaaccatcctcaggaggggacccagaaattacaacacatagctttaattgtggaggagaatttttttattgcaatacatcaagcctgtttaataggacatacatggctaatagtacagaaactaacagtacacgaaccatcacactccactgcagaataaaacaaattataaacatgtggcaagaggtgggacgagcaatgtatgcccctcccattgcaggaaacataacatgtatatcaaatatcacaggactactattgacaagggatggaggaaacagcagtaaggagacagagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgagactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatagtgatatttgggataacatgacctggatgcagtgggagggagaaattagcaattatacagaaataatatataacttgcttgaagaatcacaaaaccagcaggaaaagaatgaacaagatttactagcattggacagatggaacagtctgtggaattggtttaacataacaaagtggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcctctaccaccgattgagagacttcatattaattgcagcgagagcgggggaacttctgggacgcagcagtctcaagggactacggagagggtgggaagcccttaagtatctgggaagtcttgtgcagtattggggcctggaactaaaagggagtgctattagtctattggataccctagcaatagcagtaggtgaaggaacagataggattctagaatttgtattaggaatttgtagagctatccgcaacatacccacaagaataagacagggctttgaaacagctttgctataa

SEQ ID NO: 91 - DNA, 2577 bp, Artificial Sequence
  Description of Artificial Sequence: Synthetic polynucleotide
atgagagtgatggggagacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcacgccatgtgtaaagttgaccccactctgtgtcactctaaactgtaccgatgctaatgatactgccagcaatagcagtataataaagggaatgaataacagtatagtaggggaaatgaaaaattgctctttcaatataaccacagaattaagagataagagagagaaaaagaatgcacttttttataaacttgatatagtacaactagatggcaactctagtgagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatgccaaaacaataatagtacatctcaatgaatctgtaaagattgagtgtacgagacccagtaataacacaagaacaagtataagaataggaccaggacaagcattttatgcaacaggacaagtaataggagacataagaaaagcacattgtaacattagtgaaagtaaatggaatgaaactttacaaagggtaagtaaaaaattaaaagaatacttccctgataagaatataacatttcaaccatcctcaggaggggacccagaaattacaacacatagctttaattgtggaggagaatttttctattgcaatacatcaagcctgtttaataggacatatatggctaatagtacagatatggctaatagtgcagaaactaacagtacaagaaccatcacactccactgcagaataaaacaaattataaacatgtggcaggaggtgggacgagcaatgtatgcccctcccattgcaggaaacataacatgtatatcaaatatcacaggactactattgacaagggatggaggaaacagcagtacggagacagagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggcatagtgcaacagcaaagcaatttgctgaaggctatagaggctcaacagcatatgttgagactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatgatgatatttgggataacatgacctggatgcagtgggagggagaaattagcaattatacaaacataatatatgacttgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcctctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 92 - DNA, 2553 bp, Artificial Sequence
  Description of Artificial Sequence: Synthetic polynucleotide
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgacagcaaaagcaatatattagagggaatgaaaaattgctctttcaatataaccacagaattaagagataagagagagaaaaagaatgcacttttttataaacttgatatagtacaactaggtggcaactctaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtactcatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctcaaaagaatataacctttcaaccatcctcaggaggggacctagaaattacaacacatagctttaattgtggaggagaatttttctattgcaatacatcaagcctgtttaataggacatatatggctactggtacagatatggctaatagtacagaaactaacatcatcacaatccactgcagaataaaacaaattataaacatgtggcaggaggtgggacgagcaatgtatgcccctcccattgcaggaaacataacatgtatatcaaatatcacaggactactattgacaagggatggaggaaacagtacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctgtaa

SEQ ID NO: 93 - DNA, 2547 bp, Artificial Sequence
  Description of Artificial Sequence: Synthetic polynucleotide
atgagagtgagggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaggttgaccccactctgtgtcactctaaactgtatcaatgctactaatgctactgccagcgatagcagtatattagatggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcaaccatcctcaggaggggacctagaaattacaacacatagctttaattgtggaggagaatttttctattgcaatacatcaagcctgtttaataggacatatatggctactagtacagatttggctaatagtacagaaactaacatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtgaagagagaaaaaagagcagtgggaatgggagctatgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacagaactaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 94 - DNA, 2592 bp, Artificial Sequence
  Description of Artificial Sequence: Synthetic polynucleotide
atgagagtgatggggagacagaggaattatccacaatggtggatatggagcatgttaggcttgtggatgctaatgatttgtaatgggatgtgggtcacagtctactatggggtacctgtgtggaaagaagcaaaaactactctattttgtgcatcagatgctaaaggatatgagaaggaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtaccgatgctaatgctactgccagcaatgctaatgctactgtcagcaataccaatgctactgtcagcaatgatagcagtataatagaggaaatgaaaaattgctctttcaatataaccacagaattaagagataagatagagaaaaagtatgcacttttttataaacttgatatagtacaactagatggcaactctactcattatagattcataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccagtaataacacaagaacaagtataggaataggaccaggacaagcattttatgcaacaggacaagtaataggagacataagaaaagcacattgtaacattagtgaaagtaaatggaatgaaactttacaaagggtaagtaaaaaattaaaagaatacttccctggtaagaatataacatttcaaccatcctcaggaggggacccagaagttacaacacatagctttaattgtggaggagaatttttctattgcaatacatcaagcctgtttaatagaacatatatgactaatagtacagatatggctaatagtacagaaactaacagaaccatcacaatccactgcagaataaaacaaattataaacatgtggcaggaggtgggacgagcaatgtatgcccctcccattgcaggaaacataacatgtatatcaaatatcacaggactactattgacaagggatggaggaaacagcagtacggagacagagacattcagacctgaaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggcatagtgcaacagcaaagcaatttgctgaaggctatagaggctcaacagcatatgttgagactcacggtctggggcattaaacagctccaagcaagagtcctggccttggaaagatacctaaaggatcaacagctcctagggatgtggggctgctctggaaaactcatctgcaccactaatgtatattggaactctagttggagtaataaaacttatgatgatatttgggataacatgacctggatgcagtgggagggagaaattagcaattatacaaacataatatatgacttgcttgaagaatcacaaaaccagcaggaaaagaatgaacaagatttactagcattggacagatggaacagtctgtggaattggtttaacataacaaagtggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcctctaccaccgattgagagacttcatattaattgcagcgagagcgggggaacttctgggacgcagcagtctcaagggactacgaagagggtgggaagcccttaagtatctgggaagtcttgtgcagtattggggcctggaactaaaagggagtgctattagtctattggataccctagcaatagcagtaggtgaaggaacagataggattctagaatttgtattaggaatttgtagagctatccgcaacatacccacaagaataagacagggctttgaaacagctttgctataa

SEQ ID NO: 95 - DNA, 2556 bp, Artificial Sequence
  Description of Artificial Sequence: Synthetic polynucleotide
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaattttaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaaaagcaatatattagagggaatgaaaaattgctctttcaatataaccacagaattaagagataagagagagaaaaagaatgcacttttttataaacttgatatagtacaactaggtagcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgttagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtacagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 96 - DNA, 2556 bp, Artificial Sequence
  Description of Artificial Sequence: Synthetic polynucleotide
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgccagcgatagcagtatattagatggaatgaaaaattgctctttcaatataaccacagaattaagagataagagagagaaaaagaatgcacttttttataaacttgatatagtacaactaggtagcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaaaataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatgatgatatttgggataacatgacctggatgcaatgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtacagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 97 - DNA, 2556 bp, Artificial Sequence
  Description of Artificial Sequence: Synthetic polynucleotide
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaattttaacatgtggaaaaatgacatggtggatcagatgcatgaagatgtaattagtttatgggatcaaagcctcaagccatgtgtaaagttgaccccactctgtgtcactctaaactgtatcaatgctactaatgctactgacagcaaaagcaatatattagagggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccatgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaaggcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatgatgatatttgggataacatgacctggatgcagtgggagagagaaattagcaattatacaaacataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 98 - DNA, 2547 bp, Artificial Sequence
  Description of Artificial Sequence: Synthetic polynucleotide
atgagagtgagggggatacagaggagttatccacaatggtggatatggagcatgttaggcctttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaggttgaccccactctgtgtcactctaaactgtatcaatgctactaatgctactgccagcgatagcagtatattagatggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgagactttacaaagggtaagtgaaaaattaaaaaaatacttccctgataagaatataacatttcaaccatcctcaggaggggacctagaaattacaacacatagctttaattgtggaggagaatttttctattgcaatacatcaagcctgtttaataggacatatatggctactagtacagatatggctaatagtacagaaactaacatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatagtgatatttgggataacatgacctggatgcagtgggagagagaaattagcaattatacagacatgatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggtttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 99 - DNA, 2556 bp, Artificial Sequence
  Description of Artificial Sequence: Synthetic polynucleotide
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtatcaatgctactaatgctactgccagcgatagcagtatattagatggaatgaaaaattgctctttcaatataaccacagaattaagagataagagagagaaaaagaatgcacttttttataaacttgatatagtacaactaggtagcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatgatgatatttgggataacatgacctggatgcaatgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtacagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 100 - DNA, 2556 bp, Artificial Sequence
  Description of Artificial Sequence: Synthetic polynucleotide
atgagagtgagggggatacagaggagttatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacggaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtatcaatgctactaatgctactgccagcgatagcagtatattagatggaatgaaaaattgctctttcaatataaccacagaattaagagataagagagagaaaaagaatgcacttttttataaacttgatatagtacaactaggtggcaactctagtcagtatagattaataaattgtaatacctcagtcataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccagtaataacacaagaacaagtataagaataggaccaggacaagcattttatgcaacaggacaagtaataggaaatataagagaagcacattgtaacattagtgaaagtaaatggaatgaaactttacaaagggtaagtgaaaaattaaaagaatacttccctgataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaatcatcacaatccactgcagaataaaacaaattataaacatgtggcaggaggtgggacgagcaatgtatgcccctcccattgcaggaaacataacatgtatatcaaatatcacaggactactattgacaagggatggaggaaacaatacagaggatacggagacattcagacctgtaggaggaaatatgaaggacaattggagcagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagctggagtaataaaacttatagtgatatttgggataacatgacctggatgcagtgggagagagaaattagcaattatacagacatgatatatgaactgcttgaagaatcacaaaaccagcaggaaaagaatgaacaagatttactagcattggacagatggaacagtctatggaattggtttaacataacaaattggctgtggtatataaaaatattcataatgatagtaggaggcttgataggtttaagaataatttttgctgtgctttctttagtaaatagagttaggcagggatactcacctctgtcattgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgagggaacagataggattctagaatttgtattaggaatttgtagagctatccgcaacatacctacaagaataagacagggctttgaaacagctttgctataa

SEQ ID NO: 101 - DNA, 2589 bp, Artificial Sequence
  Description of Artificial Sequence: Synthetic polynucleotide
atgagagtgatggggagacagaggaattatccacaatggtggatatggagcacgttaggcttgcggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtgggaaaatgacatggtggatcagatgcatgaagatgtaattagtttatgggatcaaagcctcaagccatgtgtaaagttgaccccactctgtgtcactctaaactgtaccgatgctaatgctactgccagcaatgctaatgctactgtcagcaataccaatgctactgtcagcaatgatagcagtataatagaggaaatgaaaaattgctctttcaatataaccacagaattaagagataagatagagaaaaagtatgcacttttttataaacttgatatagtacaactagatggcaactctactcattatagattcataaattgtaatacctcagccataacacaagcctgtccaaaggtctcttttgacccaattcctatacattattgtgctccagctggttatgcgattctaaagtgtaataataagacattcaatggaacaggaccgtgtaataatgtcagcacagtacaatgtacacatggaattaagccagtggtttcaactcaactattgttaaatggtagcctagcagaaggagagataataattagatctgaaaatataacagacaatgccaaaacaataatagtacatctcaatgaatctgtaaagattgagtgtacgagacccagtaataacacaagaacaagtataggaataggaccaggacaagcattttatgcaacaggacaagtaataggagacataagaaaagcacattgtaacattagtgaaagtaaatggaatgaaactttacaaagggtaagtaaaaaattaaaagaatacttccctggtaagaatataacatttcaaccatcctcaggaggggacccagaagttacaacacatagctttaattgtggaggagaatttttctattgcaatacatcaagcctgtttaataggacatatatgactaatagtacagatatggctaatagtacagaaactaacagaaccatcacaatccactgcagaataaaacaaattataaacatgtggcaagaggtgggacgagcaatgtatgcccctcccattgcaggaaacataacatgtatatcaaatatcacaggactactattgacaagggatggaggaaacaatacggatccggagatattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcgtcaataacgctgacggtacaggccagacaactattgtctggtatagtgcaacagcaaagcaatttgctgaaggctatagaggctcaacagcacatgttgagactcacggtctggggcattaaacagctccaggcaagagtcctggccttggaaagatacctaaaggatcaacagctcctagggatgtggggctgctctggaaaactcatttgcaccactaatgtatattggaactctagttggagtaataaaacttatggtgatatttgggataacatgacctggatgcagtgggagagcgaaattagcaattatacaaacataatatatgatttgcttgaagaatcacaaaaccagcaggaaaagaatgaacaagatttactagcattggacagatggaacagtctgtggaattggtttaacataacaaaatggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaagagatcaacgcgattagtgagcggattcttagcgcttgtctgggacgacctgcggagcctgtgccttttcctctaccaccgattgagagacttcatattaattgcagcgagagcgggggaacttctgggacgcagcagtctcaagggactacggagagggtgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 102 - DNA, 2541 bp, Artificial Sequence; identical to SEQ ID NO: 14
  Description of Artificial Sequence: Synthetic polynucleotide

SEQ ID NO: 103 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgacaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 104 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 105 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacagacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 106 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctaaaaatataacagacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 107 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctaaaaatataacagacaatagcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 108 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacagtggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 109 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacagtgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 110 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacactgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 111 - DNA, 2541 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 112 - DNA, 2542 bp, Artificial Sequence
  Description of Artificial Sequence: Synthetic polynucleotide
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagcagcatattgtaacattaatgaaagtaaatggaatgaaactttacaaagggtaagtaaaaaattaaaagaatacttccctcataagaatataacatttcaaccatccccaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatgcggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagcttttgctataa

SEQ ID NO: 113 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaagaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgaattcgggacccggatcc

SEQ ID NO: 114 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtcaccgaattcgggacccggatcc

SEQ ID NO: 115 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaactcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtaaccgaattcgggacccggatcc

SEQ ID NO: 116 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaactcggcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggttaccgaattcgggacccggatcc

SEQ ID NO: 117 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgaattcgggtcccggatcc

SEQ ID NO: 118 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgaattcaggacccggatcc

SEQ ID NO: 119 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgaattcaggtcccggatcc

SEQ ID NO: 120 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgaattcgggacctggatcc

SEQ ID NO: 121 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaactcggggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgaattcgggtcctggatcc

SEQ ID NO: 122 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacacggcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtcaccgaattcgggtcccggatcc

SEQ ID NO: 123 - DNA, 1490 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggatcc

SEQ ID NO: 124 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaagaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtcaccgaattcgggacctggatcc

SEQ ID NO: 125 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtcaccgaattcgggtcctggatcc

SEQ ID NO: 126 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgtcatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcaagatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtaaccgaattcgggtcccggatcc

SEQ ID NO: 127 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatgttcctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagcggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcgcctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtaaccgaattcaggacccggatcc

SEQ ID NO: 128 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcatcaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtaaccgaattcaggtcccggatcc

SEQ ID NO: 129 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtaaccgaattcgggacctggatcc

SEQ ID NO: 130 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcaagatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtaaccgaattcgggtcctggatcc

SEQ ID NO: 131 - DNA, 1530 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacacgaacgccacggcctcgaactcctccacgatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcaacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggttaccgaattcgggtcccggatcc

SEQ ID NO: 132 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgaacaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtcaccgaattcaggacccggatcc

SEQ ID NO: 133 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaacgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggttaccgaattcaggacccggatcc

SEQ ID NO: 134 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgaacaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcaacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggttaccgaattcaggtcccggatcc

SEQ ID NO: 135 - DNA, 1506 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcaaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaacaacacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggttaccgaattcgggacctggatcc

SEQ ID NO: 136 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccacgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatccggaacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcaagatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggttaccgaattcgggtcctggatcc

SEQ ID NO: 137 - DNA, 1524 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacgccacggcctcgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcaagtccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggacccgaattcggtgaccggatcc

SEQ ID NO: 138 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacgtccatccggatcggccctggccaggccttctacgccaccggccaggtgatcggcgacatccgcaaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggacccgaattcggtcaccggatcc

SEQ ID NO: 139 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccacgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaacaacacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggacccgaattcggtaaccggatcc

SEQ ID NO: 140 - DNA, 1524 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacgccacggcctcgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcaagtccatccggatcggccctggccaggccttctacgccaccggccaggtgatcggcgacatccgcgaggcgtactgcaacatctccgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggacccgaattcggttaccggatcc

SEQ ID NO: 141 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccacgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgcggcacccaccaacgcccgcgagcgcgtcgtggagcgcgagaaggagtagtaagggtcccgaattcggtgaccggatcc

SEQ ID NO: 142 - DNA, 1510 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccacgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcaaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaacaacacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaggacccgaattcggtgaccggatcc

SEQ ID NO: 143 - DNA, 1510 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccacgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcaaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaggtcccgaattcggtgaccggatcc

SEQ ID NO: 144 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacatctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggacctgaattcggtgaccggatcc

SEQ ID NO: 145 - DNA, 1527 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacggccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtccagctcaacgagtccgtgaagatcgagtgcacccgcccgaacaacaagacgcgcacctccatccggatcggccctggccaggccttctacgccaccggccaggtgatcggcaacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacaccgacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggtcctgaattcggtgaccggatcc

SEQ ID NO: 146 - DNA, 1527 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgagcaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggtcccgaattcggtcaccggatcc

SEQ ID NO: 147 - DNA, 1528 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacggcgaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgcactgcaacatcagcgagtccaagtggaacaagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacaccgacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaggacccgaattcggtcaccggatcc

SEQ ID NO: 148 - DNA, 1510 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccacgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgaacaacaacacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaggtcccgaattcggtcaccggatcc

SEQ ID NO: 149 - DNA, 1497 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaagggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacatctccatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaacaactccaccgagaccaactccacgcgcaccatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacaccgacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggacctgaattcggtcaccggatcc

SEQ ID NO: 150 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagatgaccccgctgtgcgtgaccctgaactgcaccaacgccaccgcgatcaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaacaacacgcgccccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcatcgcacccaccaacgcccgcgagcgcgtcgtggagcgcgagaaggagtagtaagggtcctgaattcggtcaccggatcc

SEQ ID NO: 151 - DNA, 1530 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggggctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacggcctccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgcactgcaacatcagcgagtccaagtggaacgagaccctgcagcgcgtgtccaagaagctgaaggagtacttcccccaccagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggtcccgaattcggtaaccggatcc

SEQ ID NO: 152 - DNA, 1525 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcagctgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatcaaggaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaacatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaggacccgaattcggtaaccggatcc

SEQ ID NO: 153 - DNA, 1522 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacggccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacccggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaggtcccgaattcggtaaccggatcc

SEQ ID NO: 154 - DNA, 1533 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacggcccggaactgcacgaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacagcgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccagcatcaccggcctcctgctgacccgcgacggcggcgagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggacctgaattcggtaaccggatcc

SEQ ID NO: 155 - DNA, 1542 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacacgagggacggaggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggtcctgaattcggtaaccggatcc

SEQ ID NO: 156 - DNA, 1521 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgacgaacgccaccgcgtccaactcgtccatcatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacacggcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcgagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggtcccgaattcggttaccggatcc

SEQ ID NO: 157 - DNA, 1531 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacggcctccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtgcacctgaacgagtccgtgaagatcgagtgcacccgcccgagcaacaagacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacaccgacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaggacccgaattcggttaccggatcc

SEQ ID NO: 158 - DNA, 1528 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgcactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacaccgacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaggtcccgaattcggttaccggatcc

SEQ ID NO: 159 - DNA, 1530 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacggccagcaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcaacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacaccgacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggacctgaattcggttaccggatcc

SEQ ID NO: 160 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagatgaccccgctgtgcgtgaccctgaactgcaccaacgccaccgcgatcaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggtcctgaattcggttaccggatcc

SEQ ID NO: 161 - DNA, 1527 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacggccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcaagatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacaccgacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtgaccgggacccggatcc

SEQ ID NO: 162 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaacgccaccgcgtccaactcctccatcctcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtcaccgggacccggatcc

SEQ ID NO: 163 - DNA, 1507 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaacgccaccgcgtccaactcctccatcctcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcgagaacaacacggagaccttcgagacgttcaggccaggcggaggcaacatgaaggacaactggcgctccgagctgtacaagtacaaggtggtggaggtgaagcccctgggcgtggcacccaccaacgcccgcgagcgcgcggtggagcgcgagaaggagtagtaagaattcggtaaccgggacccggatcc

SEQ ID NO: 164 - DNA, 1555 bp, Artificial Sequence
  Description of Artificial Sequence: Synthetic polynucleotide
gtcgacaagaagccaccatgcgcgtgatgggccgccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccgacgccaccgcgtccaacgccacggcgtcgaactcgtctatcatcgaggggatgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatctcggagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacgagcaccgacatggccaactccaccgagaccaactccacgcgcatcatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggttaccgggacccggatcc

SEQ ID NO: 165 - DNA, 1546 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaacgccaccgcgtccaactcctctatcatcgaggggatgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacgtccaccgacatggccaactccaccgagaccaactccacgcgcatcatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtgaccgggtcccggatcc

SEQ ID NO: 166 - DNA, 1546 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcctctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcaccgacgccaccgcgtccaacgcaaccgcgagcaacgccacggcgtcgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagaacaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtgaccaggacccggatcc

SEQ ID NO: 167 - DNA, 1513 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccgacgccaccgcgtccaacgcaaccgcgatcaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtgaccaggtcccggatcc

SEQ ID NO: 168 - DNA, 1519 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccgacgccaccgcgtccaacgcaaccgcgagcaacgccacggcgtcgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtgaccgggacctggatcc

SEQ ID NO: 169 - DNA, 1525 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaggctgaccccgctgtgcgtgaccctgaactgcatcaacgccaccaacgcaaccgcgtccaacaactccatcctcgagggcatgaagaactgctccttcaacatcgcgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcaccgacaacgggaagaccatcatcgtgcacctgaacgagtccgtgaagatcgagtgcacccgcccgtcgaacaacacgcgcacctccatccggatcggccctggccaggccttctacgccaccggccaggtgatcggcaacatccgcgaggcgcactgcaacatctcggagtccaagtggaacgagaccctgcagcgcgtgtccaagaagctgaaggagtacttccccgacaagaacatcacgttccagccgtcgtccggcggcgacctcgagatcaccacgcactccttcagctgcggtggcgagttcttctactgcaacacgtcgtcgctgttcaaccgcacctacatggccacgaacaccgacatggccaactccaccgagaccaactccacgcgcatcatcacgatccgctgccgcatccggcagatcatcaacatgtggcaggaggtgggccgcgccatgtacgcaccgcccatcgccggcaacatcacctgcatctccaacatcaccggcctcctgctgacccgcgacggcggcgagaacaacacggagaccttcgagacgttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtgaccgggtcctggatcc

SEQ ID NO: 170 - DNA, 1546 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcctgtggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcaccgacgccaccgcgtccaacgcaaccgcgagcaacgccacggcgtcgaactcgtccatcaacagctccatcatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgcgatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgaggtcacgacgcactccttcaactgcggtggcgagttcttctactgcaacacgtcgtcgctgttcaaccgcaccgacatggccaactccaccgagaccaactccacgcgcatcatcaccatccgctgccgcatcaagcagatcgtcaacatgtggcaggaggtgggccgcgccatgtacgcaccgcccatcgccggcaacatcacctgcatctccaacatcaccggcctcctgctgacccgcgacggcggcgagaacaacggcgggaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtcaccgggtcccggatcc

SEQ ID NO: 171 - DNA, 1546 bp, Artificial Sequence
  Description of Artificial Sequence: Synthetic polynucleotide
gtcgacaagaagccaccatgcgcgtgatgggcatccagcgcaactacacgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgtgaacgccaccgcgtccaactcctctatcatcgaggggatgaactcgtccatcctcgagggcatgaagaactgctccttcaacatcacgacggagctgcgcgacaagcgcgagaagaagaacgccctgttctacaagctggacatcgtgcagctggggggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatcagcgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcgagaacaacacggagaccttcgagacgttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtcaccaggacccggatcc

SEQ ID NO: 172 - DNA, 1558 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcctgtggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccgacgccaccgcgtccaacgcaaccgcgagcaacgccacggcgtcgaacgcgaccgcgtcgaactcctccatcatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatcagcgagtccaagtggaacgagaccctgcagcgcgtgtccaagaagctgaaggagtacttcccccagaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaaccgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtcaccaggtcccggatcc

SEQ ID NO: 173 - DNA, 1528 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcgacgccaccgcgtccaacgcgacggcgatcaacatctccatcatcgaggagatgaagaactgctccttcaacatcacgacggagctgcgcgacaagcgcgagaagaagaacgccctgttctacaagctggacatcgtgcagctggacggcaactcctcgcagcacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacctccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacaccgacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtcaccgggacctggatcc

SEQ ID NO: 174 - DNA, 1516 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgagctgcacgaacgccaccaacgcgacggcgtcgaactcgtccatcctcgaggggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacctccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacacggacaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtcaccgggtcctggatcc

SEQ ID NO: 175 - DNA, 1525 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctggactgcatcaacgccaccaacgcgacggcgtcgaactcctccatcctcgaggggatgaagaactgctccttcaacatcacgacggagctgcgcgacaagcgcgagaagaagaacgccctgttctacaagctggacatcgtgcagctggggggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccaagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggtgaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcgagaacaacaccgagacgttcgagaccttcaggccagggggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtaaccgggtcccggatcc

SEQ ID NO: 176 - DNA, 1558 bp, Artificial Sequence
  Description of Artificial Sequence: Synthetic polynucleotide
gtcgacaagaagccaccatgcgcgtgatgggccgccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgacgccctgcgtgaagctgaccccgctgtgcgtgaccctgaactgcaccgacgccaccgcatccaacgcgacggcttccaacgccacggcgtcgaacgcgacagcgtcgaactcgtctatcgaggggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccgagaagctgaaggagtacttccccaacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacaccgagacgttcgagaccttcaggccagggggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtaaccaggacccggatcc

SEQ ID NO: 177 - DNA, 1513 bp, Artificial Sequence
  Description of Artificial Sequence: Synthetic polynucleotide
gtcgacaagaagccaccatgcgcgtgacgggcatccagcgcaactacccgcagtggtggatctggtcgatgctgggcctctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcatcgacgccaacgcgaccgcgtccaacgcgacggcatccaactcgtccatcatcgaggggatgaagaactgctccttcaacatcacgacggagctgcgcgacaagatcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcacgatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacaccacggagaccttcaggccagggggaggcaacatgaaggacaactggcgctccgagctgtacaagtacaaggtggtggagatcaagcccctgggcgtggcacccaccaacgcccgcgagcgcgtcgtggagcgcgagaaggagtagtaagaattcggtaaccaggtcccggatcc

SEQ ID NO: 178 - DNA, 1528 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcgacgccaccgcgtccaacgcgacggcgatcaacatctccatcatcgaggagatgaagaactgctccttcaacatcacgacggagctgcgcgacaagcgcgagaagaagaacgccctgttctacaagctggacatcgtgcagctggacggcaactcctcgcagcacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccaagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacctccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacaccgacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtaaccgggacctggatcc

SEQ ID NO: 179 - DNA, 1543 bp, Artificial Sequence
  Description of Artificial Sequence: Synthetic polynucleotide
gtcgacaagaagccaccatgcgcgtgatgggcatccagaagaactgcccgcagtggtggatctggtcgatgctgggcctctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcacggacgccaacgcaaccgcgtccaactcgtccatcatcaaggggatgaactcgtccatgatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccaagaagctgaaggagtacttcccccagaaggacatcaccttccagccgtcgtccggcggcgacctcgagatcaccacgcactccttcaactgcggtggcgagttcttctactgcaacacgtcgtcgctgttcaaccgcacctacatggccacctccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcgagaacgacaccgacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtaaccgggtcctggatcc

SEQ ID NO: 180 - DNA, 1522 bp, Artificial Sequence
  Description of Artificial Sequence: Synthetic polynucleotide
gtcgacaagaagccaccatgcgcgtgatgggcatccagcgctcgtacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgcgcctgaccccgctgtgcgtgaccctgaactgcatcaacgccaccaacgcgacggcgtcgaactcctccatcctcgaggggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgaacctgttcaaccgcacctacatggtgaactccaccgacatggccaactccaccgagaccaactccacgcgcaccatcacgatcagctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacaccgacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggttaccgggtcccggatcc

SEQ ID NO: 181 - DNA, 1519 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcaacgccaccaacgcgacggcgtcgaactcctccatcctcgaggggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttcccccagaagaacatcaccttccagccgtcgtccggcggcgacctcgagatcaccacgcactccttcaactgcggtggcgagttcttctactgcaacacgtcgtccctgttcaaccgcacctacatggcgacctccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaacgacaccgacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggttaccaggacccggatcc

SEQ ID NO: 182 - DNA, 1522 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcacggacgccaccaacgcgacggcgtcgaactcctccatcctcggcgggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgcgatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggcgaactccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacaccgacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggttaccaggtcccggatcc

SEQ ID NO: 183 - DNA, 1519 bp, Artificial Sequence
  Description of Artificial Sequence: Synthetic polynucleotide
gtcgacaagaagccaccatgcgcgtgcgcggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgcgcctgaccccgctgtgcgtgaccctgaactgcatcaacgccaccaacgcgacggcgtcgaactcctccatcctcgaggggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggcgaactccaccgacatggccaactccaccgagaccaactccacgcgcatcatcacgctgcactgccgcatcaagcagatcatcaacatgtggcaggaggtgggccgcgccatgtacgcaccgcccatcgccggcaacatcacctgcatctccaacatcaccggcctcctgctgacccgcgacggcggcaacgacaccgacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggttaccgggacctggatcc

SEQ ID NO: 184 - DNA, 1558 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcctctggatgctcatgatctgcaacggcgtgccggtgtggaaggaggccaagacgaccctgttctgcgcgtcggacgccaaggcctacgagaaggaggcgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcacggacgccaacgccaccgcgtcgaacgccaacgcgaccgcaagcaacaccaacgcgacggtgtcgaactcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaagtgatcggcgacatccgcaaggcgcactgcaacatctccgagtccaagtggaacgagaccctgcagcgcgtgtccaagaagctgaaggagtacttcccccacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctgcactgccgcatcaagcagatcatcaacatgtggcaggaggtgggccgcgccatgtacgcaccgcccatcgccggcaacatcacctgcatctccaacatcaccggcctcctgctgacccgcgacggcggcgagaacacccgggacggaggcaacaacaacacggagaccttcaggccagggggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggttaccgggtcctggatcc

SEQ ID NO: 185 - DNA, 1537 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcctctggatgctcatgatctgcaacggcgtgccggtgtggaagaaggccaagacgaccctgttctgcgcgtcggacgccaaggcctacgagaaggaggtgcacagcgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcacggacgccaacgccaccgcgtcgaacagctccatcatcaaggggatgaactcgtccatgatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttccccgaccggaacatcaccttccagccgtcgtccggcggcgaccccgagatcaccacgcactccttcaactgcggtggcaagttcttctactgcaacacgtcgtccctgttcaaccgcacctacatggccaactcgacggacatggcgaactccaccgagaccaactccacgcgcatcatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggaggcaacaacaacacggagaccttcaggccagtgggaggcaacatgaaggacaactggcgctccaagctgtacaagtacaaggtggtggaggtgaagcccctgggcgtggcacccaccaaggcccgcgagcgcatggtggagcgcgagaaggagtagtaaggtgaccgggacccgaattcggatcc

SEQ ID NO: 186 - DNA, 1555 bp, Artificial Sequence
  Description of Artificial Sequence: Synthetic polynucleotide
gtcgacaagaagccaccatgcgcgtgatgggccgccagcgcaactacccgcagtggtggatctggtcgatgctgggcctgtggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcacggacgccaacgccaccgcgtccaacacgaacgcgacagcgtccaacatcaacgcgacagcatcgaagaactccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagtcgtcgtccggcggcgacccggagatcaccacgcactccttcaactgcggtggcgagttcttctactgcaacacgtcgtccctgttcaaccgcacctacatggcgaactccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaactcttccacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtcaccgggacccgaattcggatcc

SEQ ID NO: 187 - DNA, 1558 bp, Artificial Sequence
  Description of Artificial Sequence: Synthetic polynucleotide
gtcgacaagaagccaccatgaaggtgcggggcatccagcgcaactacccgcagtggtggatctggtcgatgctgggcctctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctggagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcacggacgccaacgccaccgcgtcgaacaccaacgcgaccgcaagcaacatcaacgcgacggcgtcgaagtcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacagcaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctgcactgccgcatcaagcagatcatcaacatgtggcaggaggtgggccgcgccatgtacgcaccgcccatcgccggcaacatcacctgcatctccaacatcaccggcctcctgctgacccgcgacggcggcgagaacacccgggacggaggcaacaacaacacggagaccttcaggccagagggaggcaacatgaaggacaactggcgctccgagctgtacaagtacaaggtggtggaggtgaagcccctgggcgtggcacccaccaaggcccgcgagcgcgtcgtggagcgcgagaaggagtagtaaggtaaccgggacccgaattcggatcc

SEQ ID NO: 188 - DNA, 1537 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcacggacgccaacgccaccgcttcgaacatcaacgcgacggcgtcgaagtcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacagcaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctgcactgccgcatcaagcagatcatcaacatgtggcaggaggtgggccgcgccatgtacgcaccgcccatcgccggcaacatcacctgcatctccaacatcaccggcctcctgctgacccgcgacggcggcgagaacacccgggacggaggcaacaacaacacggagaccttcaggccagagggaggcaacatgaaggacaactggcgctccgagctgtacaagtacaaggtggtggaggtgaagcccctgggcgtggcacccaccaaggcccgcgagcgcgtcgtggagcgcgagaaggagtagtaaggttaccgggacccgaattcggatcc

SEQ ID NO: 189 - DNA, 1570 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcctctggatgctcatgacctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcacggacgccaacgccaccgcgtcgaacacgaacgcgaccgcaagcaacatcaacgcgacggcgtcgaagtcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagtcctcgtccggcggcgaccccgagatcaccacgcactccttcaactgcggtggcgagttcttctactgcaacacgtcgtccctgttcaaccgcacctacatggcgaactcgacggacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcgagaacaacggaggcaagaacaacacggagaccttcaggccagggggaggcaacatgaaggacaactggcgctccgagctgtacaagtacaaggtggtggaggtgaagcccctgggcgtggcacccaccaaggcccgcgagcgcgtcgtggagcgcgagaaggagtagtaaggtgaccgggtcccgaattcggatcc

SEQ ID NO: 190 - DNA, 1540 bp, Artificial Sequence
  Description of Artificial Sequence: Synthetic polynucleotide
gtcgacaagaagccaccatgcgcgtgcgcggcatccagcgcaactacccgcagtggtggatctggtcgatgctgggcctctggatgctcatgatctgcaacggcgtgccggtgtggaaggaggccaagacgaccctgttctgcgcgtcggacgccaaggcctacgagaaggaggcgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcacggacgccaacgccaccgcgtcgaacacgaacgcgaccgtcagcaacatcaaggcgacggtgtcgaactcctccatcatcgaggagatgaagaactgctccttcaacatcacgacggagctgcgcgacaagatcgagaagaagtacgccctgttctacaagctggacatcgtgcagctggacggcaactccacgcagtaccgcttcatcaactgcaacacctccgcgatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacgggaagaccatcatcgtgcacctgaacgagtccgtgaagatcgagtgcacccgcccggggaacaacacgcgcacctccatccggatcggccctggccaggccttctacgccaccggccaagtgatcggcgacatccgccaggcgcactgcaacatctccgagtccaagtggaacgagaccctgcagcgcgtgtccgagaagctgaaggagtacttccccaacaagacgatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaacacgaccgacatcgagaccttcaggccagggggaggcaacatgaaggacaactggcgctccgagctgtacaagtacaaggtggtggaggtgaagcccctgggcgtggcacccaccaaggcccgcgagcgcgtcgtggagcgcgagaaggagtagtaaggtgaccaggacccgaattcggatcc

SEQ ID NO: 191 - DNA, 1546 bp, Artificial Sequence
  Description of Artificial Sequence: Synthetic polynucleotide
gtcgacaagaagccaccatgcgcgtgcgcggcatccagcgcaactacccgcagtggtggatctggtcgatgctgggcctctggatgctcatgatctgcaacggcgtgccggtgtggaaggaggccaagacgaccctgttctgcgcgtcggacgccaaggcctacgagaaggaggcgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcacggacgccaacgccaccgcgtcgaacgccaacgcgaccgccagcaacacgaacgcgacggtgtcgaacgactcctccatcatcgaggagatgaagaactgctccttcaacatcacgacggagctgcgcgacaagatcgagaagaagtacgccctgttctacaagctggacatcgtgcagctggacggcaactccacgcagtaccgcttcatcaactgcaacacctccgcgatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaacaccatcatcgtgcacctgaacgagtccgtgaagatcgagtgcacccgcccgtccaacaacacgcgcacctccatccggatcggccctggccaggccttctacgccaccggccaagtgatcggcgacatccgccaggcgcactgcaacatctccgagtccaagtggaacgagaccctgcagcgcgtgtccgagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaactcgtccaaggagaccgagaccttcaggccagggggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccaggtcccgaattcggatcc

SEQ ID NO: 192 - DNA, 1522 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagacgttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaagaagtacttccccgacaagaacatcaccttccggccgtcgtccggcggcgacctcgagatcaccacgcactccttcaactgcggtggcgagttcttctactgcaacacgtcgtccctgttcaaccgcacctacatggcgacctccacggacatggccaactccaccgagacgaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgggacctgaattcggatcc

SEQ ID NO: 193 - DNA, 1525 bp, Artificial Sequence
  Description of Artificial Sequence: Synthetic polynucleotide
gtcgacaagaagccaccatgcgcgtgatgggcacccagcgcaactacccgcagtggtggatctggtcgatgctgggcctctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgtactgcatcaacgccaccgccaacgcgacggtctcgaactcctcgatcatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgcgatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgccaggcgcactgcaacatctccgagtccaagtggaacgagaccctgcagcgcgtgtccgagaagctgaaggagtacttccccaacaagacgatcaccttccagccgtcgtccggcggcgaccccgagatcaccacgcactccttcaactgcggtggcgagttcttctactgcaacacgtcgtccctgttcaaccgcacctacatggcgaactccaccgacatggccaactccaccgagacgaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaacagctccaaggagacggagaccttcaggccagggggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgggtcctgaattcggatcc

SEQ ID NO: 194 - DNA, 1522 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaagaagtacttccccgacaagaacatcaccttccggccgtcgtccggcggcgacctcgagatcaccacgcactccttcaactgcggtggcgagttcttctactgcaacacgtcgtccctgttcaaccgcacctacatggcgacgtccaccgacatggccaactccaccgagacgaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtcaccgggtcccgaattcggatcc

SEQ ID NO: 195 - DNA, 1522 bp, Artificial Sequence
  Description of Artificial Sequence: Synthetic polynucleotide
gtcgacaagaagccaccatgcgcgtgatgggcatccagcgcagctacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgagctgcatcaacgccaccaacgcgacggactcgaacaactccatcctcgaggggatgaagaactgctccttcaacatcacgacggagctgcgcgacaagcgcgagaagaagaacgccctgttctacaagctggacatcgtgcagctgtacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggcgacgtccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtcaccaggacccgaattcggatcc

SEQ ID NO: 196 - DNA, 1522 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggacggagaccctgcagcgcgtgtccgagaagctgaagaagtacttccccgacaagaacatcaccttccggccgtcgtccggcggcgacctcgagatcaccacgcactccttcaactgcggtggcgagttcttctactgcaacacgtcgtccctgttcaaccgcacctacatggcgacgtccaccgacatggccaactccaccgagatcaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtcaccaggtcccgaattcggatcc

SEQ ID NO: 197 - DNA, 1543 bp, Artificial Sequence
  Description of Artificial Sequence: Synthetic polynucleotide
gtcgacaagaagccaccatgcgcgtgatgggccggcagcgcaactacccgcagtggtggatctggtcgatgctgggcctctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgacgccctgcgtgaagctgaccccgctgtgcgtgaccctgaactgcacggacgccaacgacaccgcgtcgaacagctccatcatcaaggggatgaacaactccatcgtgggggagatgaagaactgctccttcaacatcacgacggagctgcgcgacaagcgcgagaagaagaacgccctgttctacaagctggacatcgtgcagctggacggcaactcctcggagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggccaactcgacggacatggcgaactccgcggagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggaggcaactccagcacggagacggagaccttcaggccagggggaggcaacatgaaggacaactggcgctccgagctgtacaagtacaaggtggtggaggtgaagcccctgggcgtggcacccaccaacgcccgcgagcgcgtggtggagcgcgagaaggagtagtaaggtcaccgggacctgaattcggatcc

SEQ ID NO: 198 - DNA, 1522 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcgtgccggtgtggcgggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccaagaagctgaagaagtacttccccgacaagaacatcaccttccggccgtcgtccggcggcgacctcgagatcaccacgcactccttcaactgcggtggcgagttcttctactgcaacacgtcgtccctgttcaaccgcacctacatggcgacgtccatcgacatggccaactccaccgagacgaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtcaccgggtcctgaattcggatcc

SEQ ID NO: 199 - DNA, 1522 bp, Artificial Sequence
  Description of Artificial Sequence: Synthetic polynucleotide
gtcgacaagaagccaccatgcgcgtgcgcggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcaacgccaccaacgcgacggcgtcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggcgaactccacggacatggccaactccaccgagacgaactccacgcgcatcatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtaaccgggtcccgaattcggatcc

SEQ ID NO: 200 - DNA, 1522 bp, Artificial Sequence
  Description of Artificial Sequence: Synthetic polynucleotide
gtcgacaagaagccaccatgcgcgtgcgcggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaagaagtacttccccgacaagaacatcaccttccggccgtcgtccggcggcgacctcgagatcaccacgcactccttcaactgcggtggcgagttcttctactgcaacacgtcgtccctgttcaaccgcacctacatggcgacctccacggacatggccaactccaccgagacgaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtaaccaggacccgaattcggatcc

SEQ ID NO: 201 - DNA, 1522 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaaggcgttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaagaagtacttccccgacaagaacatcaccttccggccgtcgtccggcggcgacctcgagatcaccacgcactccttcaactgcggtggcgagttcttctactgcaacacgtcgtccctgttcaaccgcacctacatggcgacctccacggacatggccaactccaccgagacgaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtaaccaggtcccgaattcggatcc

SEQ ID NO: 202 - DNA, 1519 bp, Artificial Sequence
  Description of Artificial Sequence: Synthetic polynucleotide
gtcgacaagaagccaccatgcgcgtgcgcggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaagtccaacatcctcgaggggatgaagaactgctccttcaacatcacgacggagctgcgcgacaagcgcgagaagaagaacgccctgttctacaagctggacatcgtgcagctgggcgggaactccaacagctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttcccccagaagaacatcaccttccagccgtcgtccggcggcgacctcgagatcaccacgcactccttcaactgcggtggcgagttcttctactgcaacacgtcgtccctgttcaaccgcacctacatggcgacgggcaccgacatggccaactccaccgagacgaacatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaactccacggaggacacggagaccttcaggccagtgggaggcaacatgaaggacaactggtcgtccgagctgtacaagtacaaggtggtggaggtgaagcccctgggcgtggcacccaccaacgcccgcgagcgcgtcgtggagcgcgagaaggagtagtaaggtaaccgggacctgaattcggatcc

SEQ ID NO: 203 - DNA, 1522 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcatcaacgccaccaacgcgacggcctcggactcctcgatcctcgacgggatgaagaactgctccttcaacatcacgacggagctgcgcgacaagcgcgagaagaagaacgccctgttctacaagctggacatcgtgcagctgggctccaacagctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttccccgacaagaagatcaccttccagccgtcgtccggcggcgacctcgagatcaccacgcactccttcaactgcggtggcgagttcttctactgcaacacgtcgtccctgttcaaccgcacctacatggcgaacagcaccgacatggccaactccaccgagacgaactcgacgcagatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagtgggaggcaacatgaaggacaactggtcgtccgagctgtacaagtacaaggtggtggaggtgaagcccctgggcgtggcacccaccaacgcccgcgagcgcgtcgtggagcgcgagaaggagtagtaaggtaaccgggtcctgaattcggatcc

SEQ ID NO: 204 - DNA, 1522 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaagtccaacatcctcgaggggatgaagaactgctccttcaacatcacgacggagctgcgcgacaagcgcgagaagaagaacgccctgttctacaagctggacatcgtgcagctgggcgggaacagctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggcgaacagcaccgacatggccaactccaccgagacgaactcgacgcagatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagtgggaggcaacatgaaggacaactggtcgtccgagctgtacaagtacaaggtggtggaggtgaagcccctgggcgtggcacccaccaaggcccgcgagcgcgtcgtggagcgcgagaaggagtagtaaggttaccgggtcccgaattcggatcc

SEQ ID NO: 205 - DNA, 1513 bp, Artificial Sequence
  Description of Artificial Sequence: Synthetic polynucleotide
gtcgacaagaagccaccatgcgcgtgcgcggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgcggctgaccccgctgtgcgtgaccctgaactgcatcaacgccaccaacgcgacggcctcggactccagcatcctcgacgggatgaagaactgctccttcaacatcacgacggagctgcgcgacaagcgcgagaagaagaacgccctgttctacaagctggacatcgtgcagctgggcgggaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaagaagtacttccccgacaagaacatcaccttccagccgtcgtccggcggcgacctcgagatcaccacgcactccttcaactgcggtggcgagttcttctactgcaacacgtcgtccctgttcaaccgcacctacatggcgacgtccaccgacctcgccaactccaccgagacgaacatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagtgggaggcaacatgaaggacaactggtcgtccgagctgtacaagtacaaggtggtggaggtgaagcccctgggcgtggcacccaccaacgcccgcgagcgcgtcgtgaagagggagaaggagtagtaaggttaccaggacccgaattcggatcc

SEQ ID NO: 206 - DNA, 1558 bp, Artificial Sequence
  Description of Artificial Sequence: Synthetic polynucleotide
gtcgacaagaagccaccatgcgcgtgatgggcaggcagcgcaactacccgcagtggtggatctggtcgatgctgggcctctggatgctcatgatctgcaacggcgtgccggtgtggaaggaggccaagacgaccctgttctgcgcgtcggacgccaagggctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcacggacgccaacgccaccgcgtcgaacgccaacgcgaccgtgagcaacacgaacgcgacggtgtcgaacgactcctccatcatcgaggagatgaagaactgctccttcaacatcacgacggagctgcgcgacaagatcgagaagaagtacgccctgttctacaagctggacatcgtgcagctggacggcaactccacgcactaccgcttcatcaactgcaacacctccgcgatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgtccaacaacacgcgcacctccatcgggatcggccctggccaggccttctacgccaccggccaggtcatcggcgacatccgcaaggcgcactgcaacatctccgagtccaagtggaacgagaccctgcagcgcgtgtccaagaagctgaaggagtacttccccggcaagaacatcaccttccagccgtcgtccggcggcgaccccgaagtgaccacgcactccttcaactgcggtggcgagttcttctactgcaacacgtcgtccctgttcaaccgcacctacatgacgaacagcacggacatggcgaactccaccgagaccaaccgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaactcgtccacggagaccgagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggttaccaggtcccgaattcggatcc

SEQ ID NO: 207 - DNA, 1522 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaagtccaacatcctcgaggggatgaagaactgctccttcaacatcacgacggagctgcgcgacaagcgcgagaagaagaacgccctgttctacaagctggacatcgtgcagctgggctccaacagctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggcgaacagcaccgacatggccaactccaccgagacgaactcgacgcagatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagtgggaggcaacatgaaggacaactggtcgtccgagctgtacaagtacaaggtggtggaggtgaagcccctgggcgtggcacccaccaacgcccgcgagcgcgtcgtggagcgcgagaaggagtagtaaggttaccgggacctgaattcggatcc

SEQ ID NO: 208 - DNA, 1513 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcctctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgcggctgaccccgctgtgcgtgaccctgaactgcatcaacgccaccaacgcgacggcctcggactccagcatcctcgacgggatgaagaactgctccttcaacatcacgacggagctgcgcgacaagcgcgagaagaagaacgccctgttctacaagctggacatcgtgcagctgggcgggaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaagaagtacttccccgacaagaacatcaccttccagccgtcgtccggcggcgacctcgagatcaccacgcactccttcaactgcggtggcgagttcttctactgcaacacgtcgtccctgttcaaccgcacctacatggcgacgtccaccgacatggccaactccaccgagacgaacatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagtgggaggcaacatgaaggacaactggtcgtccgagctgtacaagtacaaggtggtggaggtgaagcccctgggcgtggcacccaccaacgcccgcgagcgcgtcgtggagagggagaaggagtagtaaggttaccgggtcctgaattcggatcc

SEQ ID NO: 209 - DNA, 1539 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcatcaacgccaccaacgcgacggcctcggactccagcatcctcgacgggatgaagaactgctccttcaacatcacgacggagctgcgcgacaagcgcgagaagaagaacgccctgttctacaagctggacatcgtgcagctgggcagcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggcgaactccaccgacatggccaactccaccgagacgaacagcacgcagatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagtgggaggcaacatgaaggacaactggtcgtccgagctgtacaagtacaaggtggtggaggtgaagcccctgggcgtggcacccaccaacgcccgcgagcgcgtcgtggagagggagaaggagtagtaaggtgaccgaattcggatcc

SEQ ID NO: 210 - DNA, 1515 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcaacgccaccaacgcgacggcctcggactccagcatcctcgacgggatgaagaactgctccttcaacatcacgacggagctgcgcgacaagcgcgagaagaagaacgccctgttctacaagctggacatcgtgcagctgggcgggaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggcgaactccaccgacatggccaactccaccgagacgaacagcacgcagatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagtgggaggcaacatgaaggacaactggtcgtccgagctgtacaagtacaaggtggtggaggtgaagcccctgggcgtggcacccaccaacgcccgcgagcgcgtcgtggagagggagaaggagtagtaaggtcaccgaattcggatcc

SEQ ID NO: 211 - DNA, 1548 bp, Artificial Sequence
  Description of Artificial Sequence: Synthetic polynucleotide
gtcgacaagaagccaccatgcgcgtgatgggcaggcagcgcaactacccgcagtggtggatctggagcacgctgggcctcaggatgctcatgatctgcaacggcgtgccggtgtggaaggaggccaagacgaccctgttctgcgcgtcggacgccaaggcgtacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcacggacgccaacgccaccgcgtcgaacgccaacgcgaccgtgagcaacacgaacgcgacggtgtcgaacgactcctccatcatcgaggagatgaagaactgctccttcaacatcacgacggagctgcgcgacaagatcgagaagaagtacgccctgttctacaagctggacatcgtgcagctggacggcaactccacgcactaccgcttcatcaactgcaacacctccgcgatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacgcgaagaccatcatcgtgcacctgaacgagtccgtgaagatcgagtgcacccgcccgtccaacaacacgcgcacctccatcgggatcggccctggccaggccttctacgccaccggccaggtcatcggcgacatccgcaaggcgcactgcaacatctccgagtccaagtggaacgagaccctgcagcgcgtgtccaagaagctgaaggagtacttccccggcaagaacatcaccttccagccgtcgtccggcggcgaccccgaagtgaccacgcactccttcaactgcggtggcgagttcttctactgcaacacgtcgtccctgttcaaccgcacctacatgacgaacagcacggacatggcgaactccaccgagaccaaccgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaccccgagatcttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtaaccgaattcggatcc

SEQ ID NO: 212 - DNA, 1471 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgaacaactccaacatcatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagtggatcc

SEQ ID NO: 213 - DNA, 1497 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgtccgcgagcgcgtcgtggagcgcgagaaggagtgatagtaagaacgtcggatcc

SEQ ID NO: 214 - DNA, 1514 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgagcaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaacatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtgatagtaagaggtcccggtaaccggatcc

SEQ ID NO: 215 - DNA, 1515 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccgacgccaccgcgtccaacgcaaccgcgagcaacgccacggcgtcgaactcctccatcatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgccatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtgatagtaagaattcgggacctggatcc

SEQ ID NO: 216 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 217 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLGYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 218 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNVRRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 219 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 220 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYVILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILKFVLGICRAIRNIPTRIRQGFETALL

SEQ ID NO: 221 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILKFVLGICRAIRNIPTRIRQGFETALL

SEQ ID NO: 222 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 223 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQAKVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEDGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 224 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCITLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLSDTLAIAVGEGTDRILEFVLGICRAIRNIPTRIRQGFETALL

SEQ ID NO: 225 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMFLKNVTENFNMWKNDMVDQMHEDVISLWDQSLKPCVKLTPLCVTLNCTNATASNSSIIERMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRASIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 226 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGAAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 227 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFTLIAARAGELLGRSSLKGLRRGWEALKYLGSLVQYWGLELKRSAISLLDTLAIAVGEGTDRILEFVLGICRAIRNIPTRIRQGFETALL

SEQ ID NO: 228 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNISIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 229 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLRICRAIRNIPTRIRQGFETALL

SEQ ID NO: 230 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 231 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 232 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 233 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIRNIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 234 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNINESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRRGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 235 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 236 - protein, 845 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNAASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNINESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 237 - protein, 851 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRKSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 238 - protein, 851 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRKSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 239 - protein, 853 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNTNATASNSSTIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWIQWEREISNYTEIIYELLEESQNQQEKNEQDLLALDRWNSLWNWFNITNWLWYIKIFIMIVGGLIGLRIIFAVLSLANRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 240 - protein, 842 aa, Artificial Sequence
  Description of Artificial Sequence: Synthetic polypeptide
  MOD_RES (137)..(137): Any amino acid
MRVMGIQRNYPQWWIWSMLGFWMLMICKGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNISXIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAIGEGTDRILEFVLGICRAIRNIPTRIRQGFETALL

SEQ ID NO: 241 - protein, 857 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 242 - protein, 851 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGSCNNVSTVQCTHGIKPVVSTQLLLNGSLAEGEIIIRSENITDNGKTIIVHLNESVKIECTRPNNKTRTSIRIGPGQAFYATGQVIGDIKEAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAIGEGTDRILEFVLGICRAIRNIPTRIRQGFETALL

SEQ ID NO: 243 - protein, 852 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKVFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAITVGEGTDRILEFVLGICRAIRNIPTRIRQGFETALL

SEQ ID NO: 244 - protein, 852 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNNLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 245 - protein, 850 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNTAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGENNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 246 - protein, 850 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNPETFRPGGGNMKDNWRSELYKYKVVEVKPLGVAPTNARRRVVEREKRAVGLGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIVVGEGTDRILEFVLGICRAIRNIPTRIRQGFETALL

SEQ ID NO: 247 - protein, 852 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNVKTIIVHLNESVKIECTRPNNKTRTSIRIGPGQAFYATGQVIGDIREAHCNISESKWNKTLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRRWEALKYLGSLVQYWGLELKRSAISLLDTLAIAIGEGTDRILEFVLGICRAIRNIPTRIRQGFETALL

SEQ ID NO: 248 - protein, 852 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWLNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 249 - protein, 852 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVQLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 250 - protein, 853 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 251 - protein, 853 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPSNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 252 - protein, 853 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMGLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAHCNISESKWNETLQRVSKKLKEYFPHQNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILITARAGELLGRSSLKGLRRGWEALKYLGSLVQYWGLELKRSAISLLDTLAIAVGEGTDRILEFVLGICRAIRNIPTRIRQGFETALL

SEQ ID NO: 253 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNNTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 254 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKMTPLCVTLNCTNATAINSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKSYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 255 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKMTPLCVTLNCTNATAINSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNNTRPITIHCRIKQIINMWQEVGRAMYAPPIAGNITCISNITGLLLTRDGGKNNTETFRPGGGNMKDNWRSELYKYKVVEVKPLGIAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 256 - protein, 854 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATARNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNSGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISSITGLLLTRDGGENNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVFSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 257 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 258 - protein, 848 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATAINSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNAKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGKNNTETFETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 259 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRTITIRCRIKQIINMWQEVGRAMYAPPIAGNITCISNITGLLLTRDGGENNTETFETFRPGGGNMKDNWRSELYKYKVVEVKPLGVAPTNARRRAVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILKFVLGICRAIRNIPTRIRQGFETALL

SEQ ID NO: 260 - protein, 859 aa, Artificial Sequence
  Description of Artificial Sequence: Synthetic polypeptide
MRVMGIQRNYPQWWIWSMLGLWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISENKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRKRSTRLVSGFLALVWDDLRSLCLFIYHRLRDFILIAARAGELLGRSSLKGLRRGWEALKYLGSLVQYWGLELKRSAISLLDTLAIAVGEGTDRILEFALGICRAIRNIPTRIRQGFETALL

SEQ ID NO: 261 - protein, 850 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGNNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIGAQQHMLKLTVWGIKQLQARVLALERYLKDQQLLGMWGCSGKLICTTNVYWNSSWSNKTYGDIWDNMTWMQWEREISNYTEMIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRKRSTRLVSGFLALVWDDLRSLCLFIYHRLRDFILIAARAGELLGRSSLKGLRRGWEALKYLGSLVQYWGLELKRSAISLLDTLAIAVGEGTDRILEFALGICRAIRNIPTRIRQGFETALL

SEQ ID NO: 262 - protein, 859 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 263 - protein, 862 aa, Artificial Sequence
  Description of Artificial Sequence: Synthetic polypeptide
MRVMGRQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISDYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 264 - protein, 859 aa, Artificial Sequence
  Description of Artificial Sequence: Synthetic polypeptide
MRVMGIQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCTDATASNATASNATASNSSINSSIIEEMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEVTTHSFNCGGEFFYCNTSSLFNRTDMANSTETNSTRIITIRCRIKQIVNMWQEVGRAMYAPPIAGNITCISNITGLLLTRDGGENNGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 265 - protein, 865 aa, Artificial Sequence
  Description of Artificial Sequence: Synthetic polypeptide
MRVMGRQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDATASNATASNATASNATASNSSIIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPNKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEMIYELLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRKRSTRLVSGFLALAWDDLRSLCLFIYHRLRDFILIAARAGELLGRSSLKGLRRGWEALKYLGSLVQYWGRELKRSAISLLDTLAIAVGEGTDRILEFALRICRAIRNMPTRIRQGFETALL

SEQ ID NO: 266 - protein, 863 aa, Artificial Sequence
  Description of Artificial Sequence: Synthetic polypeptide
MRVMGIQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNATASNSSIIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPQKNITFQPSSGGDLEITTHSFNCGGEFFYCNTSSLFNRTYMANSTDMANSTETNRTITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEMIYELLEESQNQQEKNEQDLLALDRWNSLWNWFNITKWLWYIKIFIMIVGGLICLRIIFAVLSLVNRVRQGYSPLSLQTLIPSPRGPDRPGGIEEEGGEQDRKRSTRLVSGFLALVWDDLRSLCLFIYHRLRDFILIAARAGELLGRSSLKGLRRGWEALKYLGSLVQYWGLELKRSAISLLDTLAIAVGEGTDRILEFALGICRAIRNIPTRIRQGFETALL

SEQ ID NO: 267 - protein, 848 aa, Artificial Sequence
  Description of Artificial Sequence: Synthetic polypeptide
MRVTGIQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVEIKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISDYTEIIYELLEESQNQQEKNEQDLLALDRWNSLWNWFNITNWLWYIKIFIMIVGGLIGLRIIFAVLSLVNRVRQGYSPLSLQTLTPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 268 - protein, 852 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLDCINATNATASNSSILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQPSSGGDLEITTHSFNCGGEFFYCNTSSLFNRTYMVNSTDMANSTETNSTRTITIRCRIKQIINMWQEVGRAMYAPPIAGNITCISNITGLLLTRDGGENNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 269 - protein, 852 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNNSILEGMKNCSFNIATELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSKKLKEYFPDKNITFQPSSGGDLEITTHSFSCGGEFFYCNTSSLFNRTYMATNTDMANSTETNSTRIITIRCRIRQIINMWQEVGRAMYAPPIAGNITCISNITGLLLTRDGGENNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 270 - protein, 849 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLSCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGNLVQYWGLELKRSAISLLDTLAIAVGEGTDRILEFVLGICRAIRNIPTRIRQGFETALL

SEQ ID NO: 271 - protein, 853 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCIDATASNATAINISIIEEMKNCSFNITTELRDKREKKNALFYKLDIVQLDGNSSQHRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 272 - protein, 853 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCIDATASNATAINISIIEEMKNCSFNITTELRDKREKKNALFYKLDIVQLDGNSSQHRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISKSKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEKEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 273 - protein, 859 aa, Artificial Sequence
  Description of Artificial Sequence: Synthetic polypeptide
MRVMGIQRNYTQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNVNATASNSSIIEGMNSSILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGENNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWDWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 274 - protein, 850 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSEKLKEYFPQKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 275 - protein, 850 aa, Artificial Sequence
  Description of Artificial Sequence: Synthetic polypeptide
MRVRGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMANSTDMANSTETNSTRIITLHCRIKQIINMWQEVGRAMYAPPIAGNITCISNITGLLLTRDGGNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEGGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 276 - protein, 851 aa, Artificial Sequence
  Description of Artificial Sequence: Synthetic polypeptide
MRVMGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSNLFNRTYMVNSTDMANSTETNSTRTITISCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 277 - protein, 851 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATNATASNSSILGGMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 278 - protein, 858 aa, Artificial Sequence
  Description of Artificial Sequence: Synthetic polypeptide
MRVMGIQKNCPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDANATASNSSIIKGMNSSMIEEMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPQKDITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGENDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLKDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 279 - protein, 856 aa, Artificial Sequence
  Description of Artificial Sequence: Synthetic polypeptide
MRVMGIQRNYPQWWIWSMLGLWMLMICNGMWVTVYYGVPVWKKAKTTLFCASDAKAYEKEVHSVWATHACVPTDPNPQEMVLKNVTENFNMWKNDMVDQMHEDVISLWDQSLKPCVKLTPLCVTLNCTDANATASNSSIIKGMNSSMIEEMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPDRNITFQPSSGGDPEITTHSFNCGGKFFYCNTSSLFNRTYMANSTDMANSTETNSTRIITIRCRIKQIINMWQEVGRAMYAPPIAGNITCISNITGLLLTRDGGNNNTETFRPVGGNMKDNWRSKLYKYKVVEVKPLGVAPTKARRRMVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYDLLEESQNQQEKNEQDLLALDRWNSLWNWFNITKWLWYIKIFIMIVGGLIGLKIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLEGLVQYWGLELKRSAISLLDTLAIAVGEGTDRILEFVLGICRAIRNIPTRIRQGFETALL

SEQ ID NO: 280 - protein, 862 aa, Artificial Sequence
  Description of Artificial Sequence: Synthetic polypeptide
MRVMGRQRNYPQWWIWSMLGLWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNTNATASNINATASKNSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQSSSGGDPEITTHSFNCGGEFFYCNTSSLFNRTYMANSTDMANSTETNSTRIITIRCRIKQIINMWQEVGRAMYAPPIAGNITCISNITGLLLTRDGGNSSTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTEMIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRKRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 281 - protein, 867 aa, Artificial Sequence
  Description of Artificial Sequence: Synthetic polypeptide
MRVMGIQRNYPQWWIWSMLGLWMLMTCNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQSSSGGDPEITTHSFNCGGEFFYCNTSSLFNRTYMANSTDMANSTETNSTRIITIHCRIKQIINMWQEVGRAMYAPPIAGNITCISNITGLLLTRDGGENNGGKNNTETFRPGGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 282 - protein, 856 aa, Artificial Sequence
  Description of Artificial Sequence: Synthetic polypeptide
TRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCTDANATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 283 - protein, 863 aa, Artificial Sequence
  Description of Artificial Sequence: Synthetic polypeptide
MKVRGIQRNYPQWWIWSMLGLWMLMICNGMWVTVYYGVPVWKEAKTTLFCASDAKAYEKEVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 284 - protein, 863 aa, Artificial Sequence
  Description of Artificial Sequence: Synthetic polypeptide
MRVMGIQRNYPQWWIWSMLGLWMLMICNGMWVTVYYGVPVWKEAKTTLFCASDAKAYEKEAHNVWATHACVPTDPNPQEMVLKNVTENFNMWKNDMADQMHEDVISLWDQSLKPCVKLTPLCVTLNCTDANATASNANATASNTNATVSNSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 285 - protein, 851 aa, Artificial Sequence
  Description of Artificial Sequence: Synthetic polypeptide
MRVMGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLSCINATNATDSNNSILEGMKNCSFNITTELRDKREKKNALFYKLDIVQLYGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTDMIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLGQYWGLELKRSAISLLDTLAIAVGEGTDRILEFVLGICRAIRNIPTRIRQGFETALL

SEQ ID NO: 286 - protein, 851 aa, Artificial Sequence
  Description of Artificial Sequence: Synthetic polypeptide
MRVRGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTRIITLHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTDMIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWNDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 287 - protein, 851 aa, Artificial Sequence
  Description of Artificial Sequence: Synthetic polypeptide
TRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWTETLQRVSEKLKKYFPDKNITFRPSSGGDLEITTHSFNCGGEFFYCNTSSLFNRTYMATSTDMANSTEINSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 288 - protein, 851 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 289 - protein, 851 aa, Artificial Sequence
  Description of Artificial Sequence: Synthetic polypeptide
MRVRGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 290 - protein, 851 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 291 - protein, 851 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKAFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 292 - protein, 851 aa, Artificial Sequence
  Description of Artificial Sequence: Synthetic polypeptide
MRVRGIQRSYPQWWIWSMLGFWMLMICNGMWVTVYYGVPVWREAKTTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSKKLKKYFPDKNITFRPSSGGDLEITTHSFNCGGEFFYCNTSSLFNRTYMATSIDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNKVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 293 - protein, 852 aa, Artificial Sequence
  Description of Artificial Sequence: Synthetic polypeptide
MRVMGTQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLYCINATANATVSNSSIIEEMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRQAHCNISESKWNETLQRVSEKLKEYFPNKTITFQPSSGGDPEITTHSFNCGGEFFYCNTSSLFNRTYMANSTDMANSTETNSTRTITLHCRIKQIINMWQEVGRAMYAPPIAGNITCISNITGLLLTRDGGNSSKETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDLIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFLYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 294 - protein, 857 aa, Artificial Sequence
  Description of Artificial Sequence: Synthetic polypeptide
MRVRGIQRNYPQWWIWSMLGLWMLMICNGMWVTVYYGVPVWKEAKTTLFCASDAKAYEKEAHNVWATHACVPTDPNPQEMVLKNVTENFNMWENDMVDQMHEDVISLWDQSLKPCVKLTPLCVTLNCTDANATASNTNATVSNIKATVSNSSIIEEMKNCSFNITTELRDKIEKKYALFYKLDIVQLDGNSTQYRFINCNTSAITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPGNNTRTSIRIGPGQAFYATGQVIGDIRQAHCNISESKWNETLQRVSEKLKEYFPNKTITFQPSSGGDPEITTHSFNCGGEFFYCNTSSLFNRTYMANSTETNSTRTITLHCRIKQIINMWQEVGRAMYAPPIAGNITCISNITGLLLTRDGGNTTDIETFRPGGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTEIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGIVQYWGLELKRSAISLLDTLAIAVGEGTDRILEFVLGICRAIRNIPTRIRQGFETALL

SEQ ID NO: 295 - protein, 859 aa, Artificial Sequence
  Description of Artificial Sequence: Synthetic polypeptide
MRVRGIQRNYPQWWIWSMLGLWMLMICNGMWVTVYYGVPVWKEAKTTLFCASDAKAYEKEAHNVWATHACVPTDPNPQEMVLKNVTENFNMWENDMVDQMHEDVISLWDQSLKPCVKLTPLCVTLNCTDANATASNANATASNTNATVSNDSSIIEEMKNCSFNITTELRDKIEKKYALFYKLDIVQLDGNSTQYRFINCNTSAITQACPKVSFDPIPIHYCAPAGYAILKCNNKTFNGTGPCNNVSTVQCTHGIKPVVSTQLLLNGSLAEGEIIIRSKNITDNGNTIIVHLNESVKIECTRPSNNTRTSIRIGPGQAFYATGQVIGDIRQAHCNISESKWNETLQRVSEKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGNSSKETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYSDIWDNMTWMQWEGEISNYTEIIYNLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRKRSTRLVSGFLALVWDDLRSLCLFLYHRLRDFILIAARAGELLGRSSLKGLRRGWEALKYLGSLVQYWGLELKGSAISLLDTLAIAVGEGTDRILEFVLGICRAIRNIPTRIRQGFETALL

SEQ ID NO: 296 - protein, 858 aa, Artificial Sequence
  Description of Artificial Sequence: Synthetic polypeptide
MRVMGRQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDGGNSSTETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYDDIWDNMTWMQWEGEISNYTNIIYDLLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRKRSTRLVSGFLALVWDDLRSLCLFLYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 297 - protein, 850 aa, Artificial Sequence
  Description of Artificial Sequence: Synthetic polypeptide
MRVRGIQRNYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSKSNILEGMKNCSFNITTELRDKREKKNALFYKLDIVQLGGNSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPQKNITFQPSSGGDLEITTHSFNCGGEFFYCNTSSLFNRTYMATGTDMANSTETNIITIHCRIKQIINMWQEVGRAMYAPPIAGNITCISNITGLLLTRDGGNSTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 298 - protein, 848 aa, Artificial Sequence
  Description of Artificial Sequence: Synthetic polypeptide
MRVRGIQRNYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVRLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFQPSSGGDLEITTHSFNCGGEFFYCNTSSLFNRTYMATSTDLANSTETNIITIHCRIKQIINMWQEVGRAMYAPPIAGNITCISNITGLLLTRDGGNNTEDTETFRPVGGNMKDNWSSELYKYKVVEVKPLGVAPTNARRRVVKREKRAVGMGAMFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 299 - protein, 863 aa, Artificial Sequence
  Description of Artificial Sequence: Synthetic polypeptide
MRVMGRQRNYPQWWIWSMLGLWMLMICNGMWVTVYYGVPVWKEAKTTLFCASDAKGYEKEVHNVWATHACVPTDPNPQEMVLKNVTENFNMWENDMVDQMHEDVISLWDQSLKPCVKLTPLCVTLNCTDANATASNANATVSNTNATVSNDSSIIEEMKNCSFNITTELRDKIEKKYALFYKLDIVQLDGNSTHYRFINCNTSAITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIGIGPGQAFYATGQVIGDIRKAHCNISESKWNETLQRVSKKLKEYFPGKNITFQPSSGGDPEVTTHSFNCGGEFFYCNTSSLFNRTYMTNSTDMANSTETNRTITIHCRIKQIINMWQEVGRAMYAPPIAGNITCISNITGLLLTRDGGNSSTETETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYDDIWDNMTWMQWEGEISNYTNIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRKRSTRLVSGFLALVWDDLRSLCLFLYHRLRDFILIAARAGELLGRSSLKGLRRGWEALKYLGSLVQYWGLELKGSAISLLDTLAIAVGEGTDRILEFVLGICRAIRNIPTRIRQGFETALL

SEQ ID NO: 300 - protein, 851 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSKSNILEGMKNCSFNITTELRDKREKKNALFYKLDIVQLGSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 301 - protein, 851 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATASDSSILDGMKNCSFNITTELRDKREKKNALFYKLDIVQLGSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKKITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 302 - protein, 851 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSKSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 303 - protein, 848 aa, Artificial Sequence
  Description of Artificial Sequence: Synthetic polypeptide
MRVRGIQRSYPQWWIWSMLGLWMLMICNGMWVTVYYGVPVWKEAKTTLFCASDAKAYEKEVHNVWATHACVPTDPNPQEMVLKNVTENFNMWENDMVDQMHEDVISLWDQSLKPCVRLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFQPSSGGDLEITTHSFNCGGEFFYCNTSSLFNRTYMATSTDMANSTETNIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTDMIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 304 - protein, 851 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATASDSSILDGMKNCSFNITTELRDKREKKNALFYKLDIVQLGSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 305 - protein, 851 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTDMIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 306 - protein, 862 aa, Artificial Sequence
  Description of Artificial Sequence: Synthetic polypeptide
MRVMGRQRNYPQWWIWSTLGLRMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNANATVSNTNATVSNDSSIIEEMKNCSFNITTELRDKIEKKYALFYKLDIVQLDGNSTHYRFINCNTSAITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIGIGPGQAFYATGQVIGDIRKAHCNISESKWNETLQRVSKKLKEYFPGKNITFQPSSGGDPEVTTHSFNCGGEFFYCNTSSLFNRTYMTNSTDMANSTETNRTITIHCRIKQIINMWQEVGRAMYAPPIAGNITCISNITGLLLTRDGGNNTDPEIFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYGDIWDNMTWMQWESEISNYTNIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRKRSTRLVSGFLALVWDDLRSLCLFLYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 307 - protein, 846 aa, Artificial Sequence; identical to SEQ ID NO: 219
  Description of Artificial Sequence: Synthetic polypeptide

SEQ ID NO: 308 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 309 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 310 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 311 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSKNITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 312 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSKNITDNSKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 313 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNSGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 314 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNSAKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 315 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNTAKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 316 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 317 - protein, 847 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIRAAYCNINESKWNETLQRVSKKLKEYFPHKNITFQPSPGGDLEITTHSFNCGGEFFYCNTSSLFNRTYMANSTDMANSTETNNTRTITIHCRIKQIINMWQEVGRAMYAPPIAGNITCISNITGLLLTRDGGKNNAETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETAFAI

SEQ ID NO: 318 - protein, 846 aa, Artificial Sequence; identical to SEQ ID NO: 218
  Description of Artificial Sequence: Synthetic polypeptide

SEQ ID NO: 319 - protein, 849 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFILGICRAIRNIPTRIRQGFETALL

SEQ ID NO: 320 - protein, 850 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEEMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIHCRIKQIINMWQEVGRAMYAPPIAGNITCISNITGLLLTRDGGNNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKGSAISLLDTLAIAVGEGTDRILEFVLGICRAIRNIPTRIRQGFETALL

SEQ ID NO: 321 - protein, 840 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANNSNIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 322 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 323 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 324 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSKNITDNSKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 325 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNSAKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 326 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSKNITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 327 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 328 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 329 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 330 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNSGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 331 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNTAKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 332 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 333 - protein, 486 aa, Artificial Sequence; identical to SEQ ID NO: 322
  Description of Artificial Sequence: Synthetic polypeptide

SEQ ID NO: 334 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 335 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYVILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 336 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMFLKNVTENFNMWKNDMVDQMHEDVISLWDQSLKPCVKLTPLCVTLNCTNATASNSSIIERMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRASIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 337 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCITLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 338 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 339 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 340 - protein, 493 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNTNATASNSSTIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 341 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 342 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNANASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 343 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 344 - protein, 485 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNAASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNINESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 345 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIRNIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 346 - protein, 491 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRKSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 347 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 348 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 349 - protein, 491 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRKSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 350 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGAAPTNARERVVEREKE

SEQ ID NO: 351 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNINESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 352 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 353 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNISIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 354 - protein, 492 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVQLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTDTETFRPGGGNMKDNWRSELYKYKVVEVKPLGVAPTNARERVVEREKE

SEQ ID NO: 355 - protein, 492 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARERVVEREKE

SEQ ID NO: 356 - protein, 492 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNVKTIIVHLNESVKIECTRPNNKTRTSIRIGPGQAFYATGQVIGDIREAHCNISESKWNKTLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARERVVEREKE

SEQ ID NO: 357 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNNTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 358 - protein, 482 aa, Artificial Sequence
  Description of Artificial Sequence: Synthetic polypeptide
MRVMGIQRNYPQWWIWSMLGFWMLMICKGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNISIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANNSTETNSTRTITIRCRIKQIINMWQEVGRAMYAPPIAGNITCISNITGLLLTRDGGKNNTDTETFRPGGGNMKDNWRSELYKYKVVEVKPLGVAPTNARERVVEREKE

SEQ ID NO: 359 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKMTPLCVTLNCTNATAINSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNNTRPITIHCRIKQIINMWQEVGRAMYAPPIAGNITCISNITGLLLTRDGGKNNTETFRPGGGNMKDNWRSELYKYKVVEVKPLGIAPTNARERVVEREKE

SEQ ID NO: 360 - protein, 493 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMGLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAHCNISESKWNETLQRVSKKLKEYFPHQNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARERVVEREKE

SEQ ID NO: 361 - protein, 491 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGSCNNVSTVQCTHGIKPVVSTQLLLNGSLAEGEIIIRSENITDNGKTIIVHLNESVKIECTRPNNKTRTSIRIGPGQAFYATGQVIGDIKEAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNNTDTETFRPGGGNMKDNWRSELYKYKVVEVKPLGVAPTNARERVVEREKE

SEQ ID NO: 362 - protein, 490 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNPETFRPGGGNMKDNWRSELYKYKVVEVKPLGVAPTNARERVVEREKE

SEQ ID NO: 363 - protein, 494 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATARNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNSGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISSITGLLLTRDGGENNTETFRPGGGNMKDNWRSELYKYKVVEVKPLGVAPTNARERVVEREKE

SEQ ID NO: 364 - protein, 497 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNTRDGGKNNTETFRPGGGNMKDNWRSELYKYKVVEVKPLGVAPTNARERVVEREKE

SEQ ID NO: 365 - protein, 490 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNTAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGENNTETFRPGGGNMKDNWRSELYKYKVVEVKPLGVAPTNARERVVEREKE

SEQ ID NO: 366 - protein, 493 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPSNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTDTETFRPGGGNMKDNWRSELYKYKVVEVKPLGVAPTNARERVVEREKE

SEQ ID NO: 367 - protein, 492 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARERVVEREKE

SEQ ID NO: 368 - protein, 493 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTDTETFRPGGGNMKDNWRSELYKYKVVEVKPLGVAPTNARERVVEREKE

SEQ ID NO: 369 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKMTPLCVTLNCTNATAINSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 370 - protein, 492 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTDTETFRPGGGNMKDNWRSELYKYKVVEVKPLGVAPTNARERVVEREKE

SEQ ID NO: 371 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGKNNTETFETFRPGGGNMKDNWRSELYKYKVVEVKPLGVAPTNARERVVEREKE

SEQ ID NO: 372 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRTITIRCRIKQIINMWQEVGRAMYAPPIAGNITCISNITGLLLTRDGGENNTETFETFRPGGGNMKDNWRSELYKYKVVEVKPLGVAPTNARERAVEREKE

SEQ ID NO: 373 - protein, 502 aa, Artificial Sequence
  Description of Artificial Sequence: Synthetic polypeptide
MRVMGRQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARERVVEREKE

SEQ ID NO: 374 - protein, 499 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARERVVEREKE

SEQ ID NO: 375 - protein, 499 aa, Artificial Sequence
  Description of Artificial Sequence: Synthetic polypeptide
MRVMGIQRNYPQWWIWSMLGLWMLMICNGVPVWKEAKTTLFCASDAKAYEKEVHNVWATHACVPTDPNPQEMVLKNVTENFNMWENDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISENKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFETFRPGGGNMKDNWRSELYKYKVVEVKPLGVAPTNARERVVEREKE

SEQ ID NO: 376 - protein, 488 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATAINSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNAKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGKNNTETFETFRPEGGNMKDNWRSELYKYKVVEVKPLGVAPTNARERVVEREKE

SEQ ID NO: 377 - protein, 490 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGNNNTETFRPGGGNMKDNWRSELYKYKVVEVKPLGVAPTNARERVVEREKE

SEQ ID NO: 378 - protein, 492 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNNSILEGMKNCSFNIATELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSKKLKEYFPDKNITFQPSSGGDLEITTHSFSCGGEFFYCNTSSLFNRTYMATNTDMANSTETNSTRIITIRCRIRQIINMWQEVGRAMYAPPIAGNITCISNITGLLLTRDGGENNTETFETFRPGGGNMKDNWRSELYKYKVVEVKPLGVAPTNARERVVEREKE

SEQ ID NO: 379 - protein, 499 aa, Artificial Sequence
  Description of Artificial Sequence: Synthetic polypeptide
MRVMGIQRNYPQWWIWSMLGLWMLMICNGVPVWKEAKTTLFCASDAKAYEKEVHNVWATHACVPTDPNPQEMVLKNVTENFNMWKNDMADQMHEDVISLWDQSLKPCVKLTPLCVTLNCTDATASNATASNATASNSSINSSIIEEMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEVTTHSFNCGGEFFYCNTSSLFNRTDMANSTETNSTRIITIRCRIKQIVNMWQEVGRAMYAPPIAGNITCISNITGLLLTRDGGENNGGKNNTETFRPGGGNMKDNWRSELYKYKVVEVKPLGVAPTNARERVVEREKE

SEQ ID NO: 380 - protein, 499 aa, Artificial Sequence
  Description of Artificial Sequence: Synthetic polypeptide
MRVMGIQRNYTQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNVNATASNSSIIEGMNSSILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGENNTETFETFRPGGGNMKDNWRSELYKYKVVEVKPLGVAPTNARERVVEREKE

SEQ ID NO: 381 - protein, 503 aa, Artificial Sequence
  Description of Artificial Sequence: Synthetic polypeptide
MRVMGIQRNYPQWWIWSMLGLWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNATASNSSIIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPQKNITFQPSSGGDLEITTHSFNCGGEFFYCNTSSLFNRTYMANSTDMANSTETNRTITIRCRIKQIINMWQEVGRAMYAPPIAGNITCISNITGLLLTRDGGKNNTETFETFRPGGGNMKDNWRSELYKYKVVEVKPLGVAPTNARERVVEREKE

SEQ ID NO: 382 - protein, 493 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCIDATASNATAINISIIEEMKNCSFNITTELRDKREKKNALFYKLDIVQLDGNSSQHRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTETFRPEGGNMKDNWRSELYKYKVVEVKPLGVAPTNARERVVEREKE

SEQ ID NO: 383 - protein, 489 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLSCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTFRPEGGNMKDNWRSELYKYKVVEVKPLGVAPTNARERVVEREKE

SEQ ID NO: 384 - protein, 492 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLDCINATNATASNSSILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQPSSGGDLEITTHSFNCGGEFFYCNTSSLFNRTYMVNSTDMANSTETNSTRTITIRCRIKQIINMWQEVGRAMYAPPIAGNITCISNITGLLLTRDGGENNTETFETFRPGGGNMKDNWRSELYKYKVVEVKPLGVAPTNARERVVEREKE

SEQ ID NO: 385 - protein, 503 aa, Artificial Sequence
  Description of Artificial Sequence: Synthetic polypeptide
MRVMGRQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLTPCVKLTPLCVTLNCTDATASNATASNATASNATASNSSIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPNKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARERVVEREKE

SEQ ID NO: 386 - protein, 488 aa, Artificial Sequence
  Description of Artificial Sequence: Synthetic polypeptide
MRVTGIQRNYPQWWIWSMLGLWMLMICNGVPVWKEAKTTLFCASDAKAYEKEVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVEIKPLGVAPTNARERVVEREKE

SEQ ID NO: 387 - protein, 493 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCIDATASNATAINISIIEEMKNCSFNITTELRDKREKKNALFYKLDIVQLDGNSSQHRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISKSKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTETFRPEGGNMKDNWRSELYKYKVVEVKPLGVAPTNARERVVEREKE

SEQ ID NO: 388 - protein, 498 aa, Artificial Sequence
  Description of Artificial Sequence: Synthetic polypeptide
MRVMGIQKNCPQWWIWSMLGLWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTDANATASNSSIIKGMNSSMIEEMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPQKDITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGENDTDTETFRPEGGNMKDNWRSELYKYKVVEVKPLGVAPTNARERVVEREKE

SEQ ID NO: 389 - protein, 491 aa, Artificial Sequence
  Description of Artificial Sequence: Synthetic polypeptide
MRVMGIQRSYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSNLFNRTYMVNSTDMANSTETNSTRTITISCRIKQIINMWQEVGRAMYAPPIAGNITCISNITGLLLTRDGGKNDTDTETFRPEGGNMKDNWRSELYKYKVVEVKPLGVAPTNARERVVEREKE

SEQ ID NO: 390 - protein, 490 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSEKLKEYFPQKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGNDTDTETFRPEGGNMKDNWRSELYKYKVVEVKPLGVAPTNARERVVEREKE

SEQ ID NO: 391 - protein, 491 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTDATNATASNSSILGGMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGKNDTDTETFRPEGGNMKDNWRSELYKYKVVEVKPLGVAPTNARERVVEREKE

SEQ ID NO: 392 - protein, 490 aa, Artificial Sequence
  Description of Artificial Sequence: Synthetic polypeptide
MRVRGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMANSTDMANSTETNSTRIITLHCRIKQIINMWQEVGRAMYAPPIAGNITCISNITGLLLTRDGGNDTDTETFRPEGGNMKDNWRSELYKYKVVEVKPLGVAPTNARERVVEREKE

SEQ ID NO: 393 - protein, 503 aa, Artificial Sequence
  Description of Artificial Sequence: Synthetic polypeptide
MRVMGIQRNYPQWWIWSMLGLWMLMICNGVPVWKEAKTTLFCASDAKAYEKEAHNVWATHACVPTDPNPQEMVLKNVTENFNMWKNDMADQMHEDVISLWDQSLKPCVKLTPLCVTLNCTDANATASNANATASNTNATVSNSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPGGGNMKDNWRSELYKYKVVEVKPLGVAPTNARERVVEREKE

SEQ ID NO: 394 - protein, 496 aa, Artificial Sequence
  Description of Artificial Sequence: Synthetic polypeptide
MRVMGIQRNYPQWWIWSMLGLWMLMICNGVPVWKKAKTTLFCASDAKAYEKEVHSVWATHACVPTDPNPQEMVLKNVTENFNMWKNDMVDQMHEDVISLWDQSLKPCVKLTPLCVTLNCTDANATASNSSIIKGMNSSMIEEMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPDRNITFQPSSGGDPEITTHSFNCGGKFFYCNTSSLFNRTYMANSTDMANSTETNSTRIITIRCRIKQIINMWQEVGRAMYAPPIAGNITCISNITGLLLTRDGGNNNTETFRPVGGNMKDNWRSKLYKYKVVEVKPLGVAPTKARERMVEREKE

SEQ ID NO: 395 - protein, 502 aa, Artificial Sequence
  Description of Artificial Sequence: Synthetic polypeptide
MRVMGRQRNYPQWWIWSMLGLWMLMICNGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNTNATASNINATASKNSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQSSSGGDPEITTHSFNCGGEFFYCNTSSLFNRTYMANSTDMANSTETNSTRIITIRCRIKQIINMWQEVGRAMYAPPIAGNITCISNITGLLLTRDGGNSSTETFRPEGGNMKDNWRSELYKYKVVEVKPLGVAPTNARERVVEREKE

SEQ ID NO: 396 - protein, 503 aa, Artificial Sequence
  Description of Artificial Sequence: Synthetic polypeptide
MKVRGIQRNYPQWWIWSMLGLWMLMICNGVPVWKEAKTTLFCASDAKAYEKEVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARERVVEREKE

SEQ ID NO: 397 - protein, 496 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMADQMHEDVISLWDQSLKPCVKLTPLCVTLNCTDANATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARERVVEREKE

SEQ ID NO: 398 - protein, 507 aa, Artificial Sequence
  Description of Artificial Sequence: Synthetic polypeptide
MRVMGIQRNYPQWWIWSMLGLWMLMTCNGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQSSSGGDPEITTHSFNCGGEFFYCNTSSLFNRTYMANSTDMANSTETNSTRIITIHCRIKQIINMWQEVGRAMYAPPIAGNITCISNITGLLLTRDGGENNGGKNNTETFRPGGGNMKDNWRSELYKYKVVEVKPLGVAPTKARERVVEREKE

SEQ ID NO: 399 - protein, 497 aa, Artificial Sequence
  Description of Artificial Sequence: Synthetic polypeptide
MRVRGIQRNYPQWWIWSMLGLWMLMICNGVPVWKEAKTTLFCASDAKAYEKEAHNVWATHACVPTDPNPQEMVLKNVTENFNMWENDMVDQMHEDVISLWDQSLKPCVKLTPLCVTLNCTDANATASNTNATVSNIKATVSNSSIIEEMKNCSFNITTELRDKIEKKYALFYKLDIVQLDGNSTQYRFINCNTSAITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPGNNTRTSIRIGPGQAFYATGQVIGDIRQAHCNISESKWNETLQRVSEKLKEYFPNKTITFQPSSGGDPEITTHSFNCGGEFFYCNTSSLFNRTYMANSTETNSTRTITLHCRIKQIINMWQEVGRAMYAPPIAGNITCISNITGLLLTRDGGNTTDIETFRPGGGNMKDNWRSELYKYKVVEVKPLGVAPTKARERVVEREKE

SEQ ID NO: 400 - protein, 499 aa, Artificial Sequence
  Description of Artificial Sequence: Synthetic polypeptide
MRVRGIQRNYPQWWIWSMLGLWMLMICNGVPVWKEAKTTLFCASDAKAYEKEAHNVWATHACVPTDPNPQEMVLKNVTENFNMWENDMVDQMHEDVISLWDQSLKPCVKLTPLCVTLNCTDANATASNANATASNTNATVSNDSSIIEEMKNCSFNITTELRDKIEKKYALFYKLDIVQLDGNSTQYRFINCNTSAITQACPKVSFDPIPIHYCAPAGYAILKCNNKTFNGTGPCNNVSTVQCTHGIKPVVSTQLLLNGSLAEGEIIIRSKNITDNGNTIIVHLNESVKIECTRPSNNTRTSIRIGPGQAFYATGQVIGDIRQAHCNISESKWNETLQRVSEKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGNSSKETETFRPGGGNMKDNWRSELYKYKVVEVKPLGVAPTNARERVVEREKE

SEQ ID NO: 401 - protein, 491 aa, Artificial Sequence
  Description of Artificial Sequence: Synthetic polypeptide
MRVRGIQRSYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARERVVEREKE

SEQ ID NO: 402 - protein, 492 aa, Artificial Sequence
  Description of Artificial Sequence: Synthetic polypeptide
MRVMGTQRNYPQWWIWSMLGLWMLMICNGVPVWKEAKTTLFCASDAKAYEKEVHNVWATHACVPTDPNPQEMVLKNVTENFNMWKNDMADQMHEDVISLWDQSLKPCVKLTPLCVTLYCINATANATVSNSSIIEEMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRQAHCNISESKWNETLQRVSEKLKEYFPNKTITFQPSSGGDPEITTHSFNCGGEFFYCNTSSLFNRTYMANSTDMANSTETNSTRTITLHCRIKQIINMWQEVGRAMYAPPIAGNITCISNITGLLLTRDGGNSSKETETFRPGGGNMKDNWRSELYKYKVVEVKPLGVAPTNARERVVEREKE

SEQ ID NO: 403 - protein, 491 aa, Artificial Sequence
  Description of Artificial Sequence: Synthetic polypeptide
MRVRGIQRSYPQWWIWSMLGFWMLMICNGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARERVVEREKE

SEQ ID NO: 404 - protein, 491 aa, Artificial Sequence
  Description of Artificial Sequence: Synthetic polypeptide
MRVMGIQRSYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLSCINATNATDSNNSILEGMKNCSFNITTELRDKREKKNALFYKLDIVQLYGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARERVVEREKE

SEQ ID NO: 405 - protein, 491 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWTETLQRVSEKLKKYFPDKNITFRPSSGGDLEITTHSFNCGGEFFYCNTSSLFNRTYMATSTDMANSTEINSTRIITIHCRIKQIINMWQEVGRAMYAPPIAGNITCISNITGLLLTRDGGNNTEDTETFRPEGGNMKDNWRSELYKYKVVEVKPLGVAPTNARERVVEREKE

SEQ ID NO: 406 - protein, 498 aa, Artificial Sequence
  Description of Artificial Sequence: Synthetic polypeptide
MRVMGRQRNYPQWWIWSMLGLWMLMICNGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDGGNSSTETETFRPGGGNMKDNWRSELYKYKVVEVKPLGVAPTNARERVVEREKE

SEQ ID NO: 407 - protein, 491 aa, Artificial Sequence
  Description of Artificial Sequence: Synthetic polypeptide
MRVRGIQRSYPQWWIWSMLGFWMLMICNGVPVWREAKTTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSKKLKKYFPDKNITFRPSSGGDLEITTHSFNCGGEFFYCNTSSLFNRTYMATSIDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARERVVEREKE

SEQ ID NO: 408 - protein, 491 aa, Artificial Sequence
  Description of Artificial Sequence: Synthetic polypeptide
MRVRGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTRIITLHCRIKQIINMWQEVGRAMYAPPIAGNITCISNITGLLLTRDGGNNTEDTETFRPEGGNMKDNWRSELYKYKVVEVKPLGVAPTNARERVVEREKE

SEQ ID NO: 409 - protein, 491 aa, Artificial Sequence
  Description of Artificial Sequence: Synthetic polypeptide
MRVRGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARERVVEREKE

SEQ ID NO: 410 - protein, 491 aa, Artificial Sequence
  Description of Artificial Sequence: Synthetic polypeptide
MRVRGIQRSYPQWWIWSMLGFWMLMICNGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKAFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARERVVEREKE

SEQ ID NO: 411 - protein, 490 aa, Artificial Sequence
  Description of Artificial Sequence: Synthetic polypeptide
MRVRGIQRNYPQWWIWSMLGFWMLMICNGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSKSNILEGMKNCSFNITTELRDKREKKNALFYKLDIVQLGGNSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPQKNITFQPSSGGDLEITTHSFNCGGEFFYCNTSSLFNRTYMATGTDMANSTETNIITIHCRIKQIINMWQEVGRAMYAPPIAGNITCISNITGLLLTRDGGNSTEDTETFRPVGGNMKDNWSSELYKYKVVEVKPLGVAPTNARERVVEREKE

SEQ ID NO: 412 - protein, 491 aa, Artificial Sequence
  Description of Artificial Sequence: Synthetic polypeptide
MRVRGIQRSYPQWWIWSMLGFWMLMICNGVPVWKEAKTTLFCASDAKAYEKEVHNVWATHACVPTDPNPQEMVLKNVTENFNMWENDMVDQMHEDVISLWDQSLKPCVKLTPLCVTLNCINATNATASDSSILDGMKNCSFNITTELRDKREKKNALFYKLDIVQLGSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKKITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARERVVEREKE

SEQ ID NO: 413 - protein, 491 aa, Artificial Sequence
  Description of Artificial Sequence: Synthetic polypeptide
MRVRGIQRSYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSKSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTKARERVVEREKE

SEQ ID NO: 414 - protein, 488 aa, Artificial Sequence
  Description of Artificial Sequence: Synthetic polypeptide
MRVRGIQRNYPQWWIWSMLGFWMLMICNGVPVWKEAKTTLFCASDAKAYEKEVHNVWATHACVPTDPNPQEMVLKNVTENFNMWENDMVDQMHEDVISLWDQSLKPCVRLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFQPSSGGDLEITTHSFNCGGEFFYCNTSSLFNRTYMATSTDLANSTETNIITIHCRIKQIINMWQEVGRAMYAPPIAGNITCISNITGLLLTRDGGNNTEDTETFRPVGGNMKDNWSSELYKYKVVEVKPLGVAPTNARERVVKREKE

SEQ ID NO: 415 - protein, 503 aa, Artificial Sequence
  Description of Artificial Sequence: Synthetic polypeptide
MRVMGRQRNYPQWWIWSMLGLWMLMICNGVPVWKEAKTTLFCASDAKGYEKEVHNVWATHACVPTDPNPQEMVLKNVTENFNMWENDMVDQMHEDVISLWDQSLKPCVKLTPLCVTLNCTDANATASNANATVSNTNATVSNDSSIIEEMKNCSFNITTELRDKIEKKYALFYKLDIVQLDGNSTHYRFINCNTSAITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIGIGPGQAFYATGQVIGDIRKAHCNISESKWNETLQRVSKKLKEYFPGKNITFQPSSGGDPEVTTHSFNCGGEFFYCNTSSLFNRTYMTNSTDMANSTETNRTITIHCRIKQIINMWQEVGRAMYAPPIAGNITCISNITGLLLTRDGGNSSTETETFRPEGGNMKDNWRSELYKYKVVEVKPLGVAPTNARERVVEREKE

SEQ ID NO: 416 - protein, 491 aa, Artificial Sequence
  Description of Artificial Sequence: Synthetic polypeptide
MRVRGIQRSYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSKSNILEGMKNCSFNITTELRDKREKKNALFYKLDIVQLGSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARERVVEREKE

SEQ ID NO: 417 - protein, 488 aa, Artificial Sequence
  Description of Artificial Sequence: Synthetic polypeptide
MRVRGIQRSYPQWWIWSMLGLWMLMICNGVPVWKEAKTTLFCASDAKAYEKEVHNVWATHACVPTDPNPQEMVLKNVTENFNMWENDMVDQMHEDVISLWDQSLKPCVRLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFQPSSGGDLEITTHSFNCGGEFFYCNTSSLFNRTYMATSTDMANSTETNIITIHCRIKQIINMWQEVGRAMYAPPIAGNITCISNITGLLLTRDGGNNTEDTETFRPVGGNMKDNWSSELYKYKVVEVKPLGVAPTNARERVVEREKE

SEQ ID NO: 418 - protein, 499 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATASDSSILDGMKNCSFNITTELRDKREKKNALFYKLDIVQLGSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARERVVEREKE

SEQ ID NO: 419 - protein, 491 aa, Artificial Sequence
  Description of Artificial Sequence: Synthetic polypeptide
MRVRGIQRSYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARERVVEREKE

SEQ ID NO: 420 - protein, 502 aa, Artificial Sequence
  Description of Artificial Sequence: Synthetic polypeptide
MRVMGRQRNYPQWWIWSTLGLRMLMICNGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNANATVSNTNATVSNDSSIIEEMKNCSFNITTELRDKIEKKYALFYKLDIVQLDGNSTHYRFINCNTSAITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIGIGPGQAFYATGQVIGDIRKAHCNISESKWNETLQRVSKKLKEYFPGKNITFQPSSGGDPEVTTHSFNCGGEFFYCNTSSLFNRTYMTNSTDMANSTETNRTITIHCRIKQIINMWQEVGRAMYAPPIAGNITCISNITGLLLTRDGGNNTDPEIFRPGGGNMKDNWRSELYKYKVVEVKPLGVAPTNARERVVEREKE

SEQ ID NO: 421 - protein, 480 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANNSNIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 422 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNVRERVVEREKE

SEQ ID NO: 423 - protein, 489 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNDTETFRPGGGNMKDNWRSELYKYKVVEVKPLGVAPTNARERVVEREKE

SEQ ID NO: 424 - protein, 490 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEEMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIHCRIKQIINMWQEVGRAMYAPPIAGNITCISNITGLLLTRDGGNNNTETFRPGGGNMKDNWRSELYKYKVVEVKPLGVAPTNARERVVEREKE

SEQ ID NO: 425 - protein, 846 aa, Artificial Sequence; identical to SEQ ID NO: 216
  Description of Artificial Sequence: Synthetic polypeptide

SEQ ID NO: 426 - protein, 846 aa, Artificial Sequence; identical to SEQ ID NO: 310
  Description of Artificial Sequence: Synthetic polypeptide

SEQ ID NO: 427 - protein, 846 aa, Artificial Sequence; identical to SEQ ID NO: 217
  Description of Artificial Sequence: Synthetic polypeptide

SEQ ID NO: 428 - protein, 846 aa, Artificial Sequence; identical to SEQ ID NO: 254
  Description of Artificial Sequence: Synthetic polypeptide

SEQ ID NO: 429 - protein, 859 aa, Artificial Sequence; identical to SEQ ID NO: 262
  Description of Artificial Sequence: Synthetic polypeptide

SEQ ID NO: 430 - protein, 850 aa, Artificial Sequence; identical to SEQ ID NO: 261
  Description of Artificial Sequence: Synthetic polypeptide

SEQ ID NO: 431 - protein, 848 aa, Artificial Sequence; identical to SEQ ID NO: 267
  Description of Artificial Sequence: Synthetic polypeptide

SEQ ID NO: 432 - protein, 849 aa, Artificial Sequence; identical to SEQ ID NO: 270
  Description of Artificial Sequence: Synthetic polypeptide

SEQ ID NO: 433 - protein, 863 aa, Artificial Sequence; identical to SEQ ID NO: 283
  Description of Artificial Sequence: Synthetic polypeptide

SEQ ID NO: 434 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVIKQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHHFNCGGEFFYCNTSSLFNRTYMANSTDMANSTETNSTRTITIHCRIKQIINMWQEVGRAMYAPPIAGNITCISNITGLLLTRDGEKNNTETFRPGGGNMKDNWRSELYKYKVVEVKPLGVAPTNARRRVVEREKRAVGMGAVFFGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 435 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPPSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 436 - protein, 851 aa, Artificial Sequence; identical to SEQ ID NO: 276
  Description of Artificial Sequence: Synthetic polypeptide

SEQ ID NO: 437 - protein, 859 aa, Artificial Sequence; identical to SEQ ID NO: 273
  Description of Artificial Sequence: Synthetic polypeptide

SEQ ID NO: 438 - protein, 846 aa, Artificial Sequence; identical to SEQ ID NO: 217
  Description of Artificial Sequence: Synthetic polypeptide

SEQ ID NO: 439 - protein, 846 aa, Artificial Sequence; identical to SEQ ID NO: 310
  Description of Artificial Sequence: Synthetic polypeptide

SEQ ID NO: 440 - protein, 846 aa, Artificial Sequence; identical to SEQ ID NO: 221
  Description of Artificial Sequence: Synthetic polypeptide

SEQ ID NO: 441 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIRAAYCNINESKWNETLQRVSKKLKEYFPHKNITFQPSPGGDLEITTHSFNCGGEFFYCNTSSLFNRTYMANSTDMANSTETNNTRTITIHCRIKQIINMWQEVGRAMYAPPIAGNITCISNITGLLLTRDGGKNNAETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 442 - protein, 846 aa, Artificial Sequence; identical to SEQ ID NO: 254
  Description of Artificial Sequence: Synthetic polypeptide

SEQ ID NO: 443 - protein, 850 aa, Artificial Sequence; identical to SEQ ID NO: 261
  Description of Artificial Sequence: Synthetic polypeptide

SEQ ID NO: 444 - protein, 859 aa, Artificial Sequence; identical to SEQ ID NO: 262
  Description of Artificial Sequence: Synthetic polypeptide

SEQ ID NO: 445 - protein, 848 aa, Artificial Sequence; identical to SEQ ID NO: 267
  Description of Artificial Sequence: Synthetic polypeptide

SEQ ID NO: 446 - protein, 849 aa, Artificial Sequence; identical to SEQ ID NO: 270
  Description of Artificial Sequence: Synthetic polypeptide

SEQ ID NO: 447 - protein, 859 aa, Artificial Sequence; identical to SEQ ID NO: 273
  Description of Artificial Sequence: Synthetic polypeptide

SEQ ID NO: 448 - protein, 851 aa, Artificial Sequence; identical to SEQ ID NO: 276
  Description of Artificial Sequence: Synthetic polypeptide

SEQ ID NO: 449 - protein, 863 aa, Artificial Sequence; identical to SEQ ID NO: 283
  Description of Artificial Sequence: Synthetic polypeptide

SEQ ID NO: 450 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 451 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLGYIKIFIMIVGGLIGLRIIFAVLSLVNRVRQG

SEQ ID NO: 452 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNVRRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 453 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQAKVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 454 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 455 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKMTPLCVTLNCTNATAINSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKSYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 456 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKMTPLCVTLNCTNATAINSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNNTRPITIHCRIKQIINMWQEVGRAMYAPPIAGNITCISNITGLLLTRDGGKNNTETFRPGGGNMKDNWRSELYKYKVVEVKPLGIAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 457 - protein, 698 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGNNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIGAQQHMLKLTVWGIKQLQARVLALERYLKDQQLLGMWGCSGKLICTTNVYWNSSWSNKTYGDIWDNMTWMQWEREISNYTEMIYELLEESQNQQEKNEQDLLALDRWNSLWNWFNITNWLWYIKIFIMIVGGLIGLRIIFAVLSLVNRVRQG

SEQ ID NO: 458 - protein, 697 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLSCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQG

SEQ ID NO: 459 - protein, 710 aa, Artificial Sequence
  Description of Artificial Sequence: Synthetic polypeptide
MRVMGRQRNYPQWWIWSMLGLWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNTNATASNINATASKNSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQSSSGGDPEITTHSFNCGGEFFYCNTSSLFNRTYMANSTDMANSTETNSTRIITIRCRIKQIINMWQEVGRAMYAPPIAGNITCISNITGLLLTRDGGNSSTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTEMIYDLLEESQNQQEKNEQDLLALDRWNSLWNWFNITKWLWYIKIFIMIVGGLIGLRIIFAVLSLVNRVRQG

SEQ ID NO: 460 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYVILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 461 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMFLKNVTENFNMWKNDMVDQMHEDVISLWDQSLKPCVKLTPLCVTLNCTNATASNSSIIERMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRASIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 462 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 463 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNISIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 464 - protein, 693 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNAASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNINESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 465 - protein, 697 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 466 - protein, 698 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEEMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIHCRIKQIINMWQEVGRAMYAPPIAGNITCISNITGLLLTRDGGNNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 467 - protein, 710 aa, Artificial Sequence
  Description of Artificial Sequence: Synthetic polypeptide
MRVMGRQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISDYTEIIYELLEESQNQQEKNEQDLLALDRWNSLWNWFNITNWLWYIKIFIMIVGGLIGLRIIFAVLSLVNRVRQG

SEQ ID NO: 468 - protein, 700 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNNSILEGMKNCSFNIATELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSKKLKEYFPDKNITFQPSSGGDLEITTHSFSCGGEFFYCNTSSLFNRTYMATNTDMANSTETNSTRIITIRCRIRQIINMWQEVGRAMYAPPIAGNITCISNITGLLLTRDGGENNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQG

SEQ ID NO: 469 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 470 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 471 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSKNITDNSKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 472 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNSAKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 473 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSKNITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 474 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 475 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 476 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 477 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNSGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 478 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNTAKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 479 - protein, 694 aa, Artificial Sequence; identical to SEQ ID NO: 469
  Description of Artificial Sequence: Synthetic polypeptide

SEQ ID NO: 480 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 481 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCITLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 482 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 483 - protein, 701 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNTNATASNSSTIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWIQWEREISNYTEIIYELLEESQNQQEKNEQDLLALDRWNSLWNWFNITNWLWYIKIFIMIVGGLIGLRIIFAVLSLANRVRQG

SEQ ID NO: 484 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 485 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 486 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIRNIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 487 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 488 - protein, 699 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRKSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 489 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGAAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 490 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNINESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRRG

SEQ ID NO: 491 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 492 - protein, 700 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVQLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 493 - protein, 700 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKVFIMIVGGLIGLRIIFAVLSLVNRVRQG

SEQ ID NO: 494 - protein, 700 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNVKTIIVHLNESVKIECTRPNNKTRTSIRIGPGQAFYATGQVIGDIREAHCNISESKWNKTLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 495 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNNTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 496 - protein, 690 aa, Artificial Sequence
  Description of Artificial Sequence: Synthetic polypeptide
MRVMGIQRNYPQWWIWSMLGFWMLMICKGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNISIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANNSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 497 - protein, 699 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRKSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 498 - protein, 714 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMGLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAHCNISESKWNETLQRVSKKLKEYFPHQNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGGSRIRPDPDLLCL

SEQ ID NO: 499 - protein, 699 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGSCNNVSTVQCTHGIKPVVSTQLLLNGSLAEGEIIIRSENITDNGKTIIVHLNESVKIECTRPNNKTRTSIRIGPGQAFYATGQVIGDIKEAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 500 - protein, 698 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNPETFRPGGGNMKDNWRSELYKYKVVEVKPLGVAPTNARRRVVEREKRAVGLGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 501 - protein, 705 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 502 - protein, 698 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNTAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGENNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 503 - protein, 701 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPSNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 504 - protein, 700 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNNLWNWFNITNWLWYIKIFIMIVGGLIGLRIIFAVLSLVNRVRQG

SEQ ID NO: 505 - protein, 701 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 506 - protein, 700 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWLNITNWLWYIKIFIMIVGGLIGLRIIFAVLSLVNRVRQG

SEQ ID NO: 507 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 508 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRTITIRCRIKQIINMWQEVGRAMYAPPIAGNITCISNITGLLLTRDGGENNTETFETFRPGGGNMKDNWRSELYKYKVVEVKPLGVAPTNARRRAVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 509 - protein, 707 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 510 - protein, 707 aa, Artificial Sequence
  Description of Artificial Sequence: Synthetic polypeptide
MRVMGIQRNYPQWWIWSMLGLWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISENKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 511 - protein, 696 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATAINSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNAKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGKNNTETFETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 512 - protein, 707 aa, Artificial Sequence
  Description of Artificial Sequence: Synthetic polypeptide
MRVMGIQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCTDATASNATASNATASNSSINSSIIEEMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEVTTHSFNCGGEFFYCNTSSLFNRTDMANSTETNSTRIITIRCRIKQIVNMWQEVGRAMYAPPIAGNITCISNITGLLLTRDGGENNGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITKWLWYIKIFIMIVGGLIGLRIIFAVLSLVNRVRQG

SEQ ID NO: 513 - protein, 707 aa, Artificial Sequence
  Description of Artificial Sequence: Synthetic polypeptide
MRVMGIQRNYTQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNVNATASNSSIIEGMNSSILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGENNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWDWFNITNWLWYIKIFIMIVGGLIGLRIIFAVLSLVNRVRQG

SEQ ID NO: 514 - protein, 711 aa, Artificial Sequence
  Description of Artificial Sequence: Synthetic polypeptide
MRVMGIQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNATASNSSIIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPQKNITFQPSSGGDLEITTHSFNCGGEFFYCNTSSLFNRTYMANSTDMANSTETNRTITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEMIYELLEESQNQQEKNEQDLLALDRWNSLWNWFNITKWLWYIKIFIMIVGGLICLRIIFAVLSLVNRVRQG

SEQ ID NO: 515 - protein, 701 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCIDATASNATAINISIIEEMKNCSFNITTELRDKREKKNALFYKLDIVQLDGNSSQHRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQG

SEQ ID NO: 516 - protein, 700 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLDCINATNATASNSSILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQPSSGGDLEITTHSFNCGGEFFYCNTSSLFNRTYMVNSTDMANSTETNSTRTITIRCRIKQIINMWQEVGRAMYAPPIAGNITCISNITGLLLTRDGGENNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQG

SEQ ID NO: 517 - protein, 725 aa, Artificial Sequence
  Description of Artificial Sequence: Synthetic polypeptide
MRVMGRQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDATASNATASNATASNATASNSSIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPNKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEMIYELLEESQNQQEKNEQDLLALDRWNSLWNWFNITKWLWYIKIFIMIVGGLIGLRIIFAVLSLVNRVRQGEFGNQDPDPDLLCL

SEQ ID NO: 518 - protein, 696 aa, Artificial Sequence
  Description of Artificial Sequence: Synthetic polypeptide
MRVTGIQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVEIKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISDYTEIIYELLEESQNQQEKNEQDLLALDRWNSLWNWFNITNWLWYIKIFIMIVGGLIGLRIIFAVLSLVNRVRQG

SEQ ID NO: 519 - protein, 701 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCIDATASNATAINISIIEEMKNCSFNITTELRDKREKKNALFYKLDIVQLDGNSSQHRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISKSKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQG

SEQ ID NO: 520 - protein, 706 aa, Artificial Sequence
  Description of Artificial Sequence: Synthetic polypeptide
MRVMGIQKNCPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDANATASNSSIIKGMNSSMIEEMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPQKDITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGENDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQG

SEQ ID NO: 521 - protein, 699 aa, Artificial Sequence
  Description of Artificial Sequence: Synthetic polypeptide
MRVMGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSNLFNRTYMVNSTDMANSTETNSTRTITISCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQG

SEQ ID NO: 522 - protein, 698 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSEKLKEYFPQKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQG

SEQ ID NO: 523 - protein, 699 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATNATASNSSILGGMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQG

SEQ ID NO: 524 - protein, 698 aa, Artificial Sequence
  Description of Artificial Sequence: Synthetic polypeptide
MRVRGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMANSTDMANSTETNSTRIITLHCRIKQIINMWQEVGRAMYAPPIAGNITCISNITGLLLTRDGGNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQG

SEQ ID NO: 525 - protein, 711 aa, Artificial Sequence
  Description of Artificial Sequence: Synthetic polypeptide
MRVMGIQRNYPQWWIWSMLGLWMLMICNGMWVTVYYGVPVWKEAKTTLFCASDAKAYEKEAHNVWATHACVPTDPNPQEMVLKNVTENFNMWKNDMADQMHEDVISLWDQSLKPCVKLTPLCVTLNCTDANATASNANATASNTNATVSNSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYDLLEESQNQQEKNEQDLLALDRWNSLWNWFNITKWLWYIKIFIMIVGGLIGLRIIFAVLSLVNRVRQG

SEQ ID NO: 526 - protein, 704 aa, Artificial Sequence
  Description of Artificial Sequence: Synthetic polypeptide
MRVMGIQRNYPQWWIWSMLGLWMLMICNGMWVTVYYGVPVWKKAKTTLFCASDAKAYEKEVHSVWATHACVPTDPNPQEMVLKNVTENFNMWKNDMVDQMHEDVISLWDQSLKPCVKLTPLCVTLNCTDANATASNSSIIKGMNSSMIEEMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPDRNITFQPSSGGDPEITTHSFNCGGKFFYCNTSSLFNRTYMANSTDMANSTETNSTRIITIRCRIKQIINMWQEVGRAMYAPPIAGNITCISNITGLLLTRDGGNNNTETFRPVGGNMKDNWRSKLYKYKVVEVKPLGVAPTKARRRMVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYDLLEESQNQQEKNEQDLLALDRWNSLWNWFNITKWLWYIKIFIMIVGGLIGLKIIFAVLSLVNRVRQG

SEQ ID NO: 527 - protein, 711 aa, Artificial Sequence
  Description of Artificial Sequence: Synthetic polypeptide
MKVRGIQRNYPQWWIWSMLGLWMLMICNGMWVTVYYGVPVWKEAKTTLFCASDAKAYEKEVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYDLLEESQNQQEKNEQDLLALDRWNSLWNWFNITKWLWYIKIFIMIVGGLIGLRIIFAVLSLVNRVRQG

SEQ ID NO: 528 - protein, 704 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCTDANATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQG

SEQ ID NO: 529 - protein, 715 aa, Artificial Sequence
  Description of Artificial Sequence: Synthetic polypeptide
MRVMGIQRNYPQWWIWSMLGLWMLMTCNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQSSSGGDPEITTHSFNCGGEFFYCNTSSLFNRTYMANSTDMANSTETNSTRIITIHCRIKQIINMWQEVGRAMYAPPIAGNITCISNITGLLLTRDGGENNGGKNNTETFRPGGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYDLLEESQNQQEKNEQDLLALDRWNSLWNWFNITKWLWYIKIFIMIVGGLIGLRIIFAVLSLVNRVRQG

SEQ ID NO: 530 - protein, 705 aa, Artificial Sequence
  Description of Artificial Sequence: Synthetic polypeptide
MRVRGIQRNYPQWWIWSMLGLWMLMICNGMWVTVYYGVPVWKEAKTTLFCASDAKAYEKEAHNVWATHACVPTDPNPQEMVLKNVTENFNMWENDMVDQMHEDVISLWDQSLKPCVKLTPLCVTLNCTDANATASNTNATVSNIKATVSNSSIIEEMKNCSFNITTELRDKIEKKYALFYKLDIVQLDGNSTQYRFINCNTSAITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPGNNTRTSIRIGPGQAFYATGQVIGDIRQAHCNISESKWNETLQRVSEKLKEYFPNKTITFQPSSGGDPEITTHSFNCGGEFFYCNTSSLFNRTYMANSTETNSTRTITLHCRIKQIINMWQEVGRAMYAPPIAGNITCISNITGLLLTRDGGNTTDIETFRPGGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTEIIYDLLEESQNQQEKNEQDLLALDRWNSLWNWFNITKWLWYIKIFIMIVGGLIGLRIIFAVLSLVNRVRQG

SEQ ID NO: 531 - protein, 707 aa, Artificial Sequence
  Description of Artificial Sequence: Synthetic polypeptide
MRVRGIQRNYPQWWIWSMLGLWMLMICNGMWVTVYYGVPVWKEAKTTLFCASDAKAYEKEAHNVWATHACVPTDPNPQEMVLKNVTENFNMWENDMVDQMHEDVISLWDQSLKPCVKLTPLCVTLNCTDANATASNANATASNTNATVSNDSSIIEEMKNCSFNITTELRDKIEKKYALFYKLDIVQLDGNSTQYRFINCNTSAITQACPKVSFDPIPIHYCAPAGYAILKCNNKTFNGTGPCNNVSTVQCTHGIKPVVSTQLLLNGSLAEGEIIIRSKNITDNGNTIIVHLNESVKIECTRPSNNTRTSIRIGPGQAFYATGQVIGDIRQAHCNISESKWNETLQRVSEKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGNSSKETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYSDIWDNMTWMQWEGEISNYTEIIYNLLEESQNQQEKNEQDLLALDRWNSLWNWFNITKWLWYIKIFIMIVGGLIGLRIIFAVLSLVNRVRQG

SEQ ID NO: 532 - protein, 699 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQG

SEQ ID NO: 533 - protein, 700 aa, Artificial Sequence
  Description of Artificial Sequence: Synthetic polypeptide
MRVMGTQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLYCINATANATVSNSSIIEEMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRQAHCNISESKWNETLQRVSEKLKEYFPNKTITFQPSSGGDPEITTHSFNCGGEFFYCNTSSLFNRTYMANSTDMANSTETNSTRTITLHCRIKQIINMWQEVGRAMYAPPIAGNITCISNITGLLLTRDGGNSSKETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDLIYDLLEESQNQQEKNEQDLLALDRWNSLWNWFNITKWLWYIKIFIMIVGGLIGLRIIFAVLSLVNRVRQG

SEQ ID NO: 534 - protein, 699 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQG

SEQ ID NO: 535 - protein, 699 aa, Artificial Sequence
  Description of Artificial Sequence: Synthetic polypeptide
MRVMGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLSCINATNATDSNNSILEGMKNCSFNITTELRDKREKKNALFYKLDIVQLYGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTDMIYELLEESQNQQEKNEQDLLALDRWNSLWNWFNITNWLWYIKIFIMIVGGLIGLRIIFAVLSLVNRVRQG

SEQ ID NO: 536 - protein, 699 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWTETLQRVSEKLKKYFPDKNITFRPSSGGDLEITTHSFNCGGEFFYCNTSSLFNRTYMATSTDMANSTEINSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQG

SEQ ID NO: 537 - protein, 706 aa, Artificial Sequence
  Description of Artificial Sequence: Synthetic polypeptide
MRVMGRQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDGGNSSTETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYDDIWDNMTWMQWEGEISNYTNIIYDLLEESQNQQEKNEQDLLALDRWNSLWNWFNITNWLWYIKIFIMIVGGLIGLRIIFAVLSLVNRVRQG

SEQ ID NO: 538 - protein, 699 aa, Artificial Sequence
  Description of Artificial Sequence: Synthetic polypeptide
MRVRGIQRSYPQWWIWSMLGFWMLMICNGMWVTVYYGVPVWREAKTTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSKKLKKYFPDKNITFRPSSGGDLEITTHSFNCGGEFFYCNTSSLFNRTYMATSIDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNKVRQG

SEQ ID NO: 539 - protein, 699 aa, Artificial Sequence
  Description of Artificial Sequence: Synthetic polypeptide
MRVRGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTRIITLHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTDMIYELLEESQNQQEKNEQDLLALDRWNSLWNWFNITNWLWYIKIFIMIVGGLIGLRIIFAVLSLVNRVRQG

SEQ ID NO: 540 - protein, 699 aa, Artificial Sequence
  Description of Artificial Sequence: Synthetic polypeptide
MRVRGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQG

SEQ ID NO: 541 - protein, 699 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKAFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQG

SEQ ID NO: 542 - protein, 698 aa, Artificial Sequence
  Description of Artificial Sequence: Synthetic polypeptide
MRVRGIQRNYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSKSNILEGMKNCSFNITTELRDKREKKNALFYKLDIVQLGGNSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPQKNITFQPSSGGDLEITTHSFNCGGEFFYCNTSSLFNRTYMATGTDMANSTETNIITIHCRIKQIINMWQEVGRAMYAPPIAGNITCISNITGLLLTRDGGNSTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQG

SEQ ID NO: 543 - protein, 699 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATASDSSILDGMKNCSFNITTELRDKREKKNALFYKLDIVQLGSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKKITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 544 - protein, 699 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSKSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQG

SEQ ID NO: 545 - protein, 696 aa, Artificial Sequence
  Description of Artificial Sequence: Synthetic polypeptide
MRVRGIQRNYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVRLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFQPSSGGDLEITTHSFNCGGEFFYCNTSSLFNRTYMATSTDLANSTETNIITIHCRIKQIINMWQEVGRAMYAPPIAGNITCISNITGLLLTRDGGNNTEDTETFRPVGGNMKDNWSSELYKYKVVEVKPLGVAPTNARRRVVKREKRAVGMGAMFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTELIYELLEESQNQQEKNEQDLLALDRWNSLWNWFNITNWLWYIKIFIMIVGGLIGLRIIFAVLSLVNRVRQG

SEQ ID NO: 546 - protein, 711 aa, Artificial Sequence
  Description of Artificial Sequence: Synthetic polypeptide
MRVMGRQRNYPQWWIWSMLGLWMLMICNGMWVTVYYGVPVWKEAKTTLFCASDAKGYEKEVHNVWATHACVPTDPNPQEMVLKNVTENFNMWENDMVDQMHEDVISLWDQSLKPCVKLTPLCVTLNCTDANATASNANATVSNTNATVSNDSSIIEEMKNCSFNITTELRDKIEKKYALFYKLDIVQLDGNSTHYRFINCNTSAITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIGIGPGQAFYATGQVIGDIRKAHCNISESKWNETLQRVSKKLKEYFPGKNITFQPSSGGDPEVTTHSFNCGGEFFYCNTSSLFNRTYMTNSTDMANSTETNRTITIHCRIKQIINMWQEVGRAMYAPPIAGNITCISNITGLLLTRDGGNSSTETETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYDDIWDNMTWMQWEGEISNYTNIIYDLLEESQNQQEKNEQDLLALDRWNSLWNWFNITKWLWYIKIFIMIVGGLIGLRIIFAVLSLVNRVRQG

SEQ ID NO: 547 - protein, 699 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSKSNILEGMKNCSFNITTELRDKREKKNALFYKLDIVQLGSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQG

SEQ ID NO: 548 - protein, 696 aa, Artificial Sequence
  Description of Artificial Sequence: Synthetic polypeptide
MRVRGIQRSYPQWWIWSMLGLWMLMICNGMWVTVYYGVPVWKEAKTTLFCASDAKAYEKEVHNVWATHACVPTDPNPQEMVLKNVTENFNMWENDMVDQMHEDVISLWDQSLKPCVRLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFQPSSGGDLEITTHSFNCGGEFFYCNTSSLFNRTYMATSTDMANSTETNIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTDMIYELLEESQNQQEKNEQDLLALDRWNSLWNWFNITNWLWYIKIFIMIVGGLIGLRIIFAVLSLVNRVRQG

SEQ ID NO: 549 - protein, 699 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATASDSSILDGMKNCSFNITTELRDKREKKNALFYKLDIVQLGSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 550 - protein, 699 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTDMIYELLEESQNQQEKNEQDLLALDRWNSLWNWFNITNWLWYIKIFIMIVGGLIGLRIIFAVLSLVNRVRQG

SEQ ID NO: 551 - protein, 710 aa, Artificial Sequence
  Description of Artificial Sequence: Synthetic polypeptide
MRVMGRQRNYPQWWIWSTLGLRMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNANATVSNTNATVSNDSSIIEEMKNCSFNITTELRDKIEKKYALFYKLDIVQLDGNSTHYRFINCNTSAITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIGIGPGQAFYATGQVIGDIRKAHCNISESKWNETLQRVSKKLKEYFPGKNITFQPSSGGDPEVTTHSFNCGGEFFYCNTSSLFNRTYMTNSTDMANSTETNRTITIHCRIKQIINMWQEVGRAMYAPPIAGNITCISNITGLLLTRDGGNNTDPEIFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYGDIWDNMTWMQWESEISNYTNIIYDLLEESQNQQEKNEQDLLALDRWNSLWNWFNITKWLWYIKIFIMIVGGLIGLRIIFAVLSLVNRVRQG

SEQ ID NO: 552 - protein, 688 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANNSNIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 553 - protein, 702 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATARNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNSGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISSITGLLLTRDGGENNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVFSLVNRVRQG

SEQ ID NO: 554 - DNA, 2128 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggatccagatctgctgtgcctt

SEQ ID NO: 555 - DNA, 2131 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctggggtacatcaagatcttcatcatgatcgtgggcggcctgatcggcctgcgcatcatcttcgccgtgctgtcgctggtgaaccgcgtgcgccagggctgatgagaacggatccagatctgctgtgcctt

SEQ ID NO: 556 - DNA, 2134 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgtccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaacgtcggatccagatctgctgtgcctt

SEQ ID NO: 557 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccaaggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtaaccgaattcgggacctggatccagatctgctgtgcctt

SEQ ID NO: 558 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacgtccatccggatcggccctggccaggccttctacgccaccggccaggtgatcggcgacatccgcaaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggacccgaattcggtcaccggatccagatctgctgtgcctt

SEQ ID NO: 559 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagatgaccccgctgtgcgtgaccctgaactgcaccaacgccaccgcgatcaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagagctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggtcctgaattcggttaccggatccagatctgctgtgcctt

SEQ ID NO: 560 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagatgaccccgctgtgcgtgaccctgaactgcaccaacgccaccgcgatcaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaacaacacgcgccccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcatcgcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctagtaagggtcctgaattcggtcaccggatccagatctgctgtgcctt

SEQ ID NO: 561 - DNA, 2159 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccgacgccaccgcgtccaacgcaaccgcgagcaacgccacggcgtcgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcggggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatgatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtgaccgggacctggatccagatctgctgtgcctt

SEQ ID NO: 562 - DNA, 2156 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgagctgcacgaacgccaccaacgcgacggcgtcgaactcgtccatcctcgaggggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacctccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacacggacaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagctgatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtcaccgggtcctggatccagatctgctgtgcctt

SEQ ID NO: 563 - DNA, 2195 bp, Artificial Sequence
  Description of Artificial Sequence: Synthetic polynucleotide
gtcgacaagaagccaccatgcgcgtgatgggccgccagcgcaactacccgcagtggtggatctggtcgatgctgggcctgtggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcacggacgccaacgccaccgcgtccaacacgaacgcgacagcgtccaacatcaacgcgacagcatcgaagaactccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagtcgtcgtccggcggcgacccggagatcaccacgcactccttcaactgcggtggcgagttcttctactgcaacacgtcgtccctgttcaaccgcacctacatggcgaactccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaactcttccacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagcgcgagatctccaactacaccgagatgatctacgacctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatcggcctgcgcatcatcttcgccgtgctgtcgctggtgaaccgcgtgcgccagggctgatgaggtcaccgggacccgaattcggatccagatctgctgtgcctt

SEQ ID NO: 564 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgtcatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcaagatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctagtaaggtaaccgaattcgggtcccggatccagatctgctgtgcctt

SEQ ID NO: 565 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatgttcctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagcggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcgcctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtaaccgaattcaggacccggatccagatctgctgtgcctt

SEQ ID NO: 566 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaacgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggttaccgaattcaggacccggatccagatctgctgtgcctt

SEQ ID NO: 567 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacatctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggacctgaattcggtgaccggatccagatctgctgtgcctt

SEQ ID NO: 568 - DNA, 2144 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcaaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaacaacacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggttaccgaattcgggacctggatccagatctgctgtgcctt

SEQ ID NO: 569 - DNA, 2151 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgagcaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaacatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaggtcccggtaaccggatccagatctgctgtgcctt

SEQ ID NO: 570 - DNA, 2152 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccgacgccaccgcgtccaacgcaaccgcgagcaacgccacggcgtcgaactcctccatcatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgccatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcgggacctggatccagatctgctgtgcctt

SEQ ID NO: 571 - DNA, 2195 bp, Artificial Sequence
  Description of Artificial Sequence: Synthetic polynucleotide
gtcgacaagaagccaccatgcgcgtgatgggccgccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccgacgccaccgcgtccaacgccacggcgtcgaactcgtctatcatcgaggggatgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatctcggagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacgagcaccgacatggccaactccaccgagaccaactccacgcgcatcatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccgactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggttaccgggacccggatccagatctgctgtgcctt

SEQ ID NO: 572 - DNA, 2165 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaggctgaccccgctgtgcgtgaccctgaactgcatcaacgccaccaacgcaaccgcgtccaacaactccatcctcgagggcatgaagaactgctccttcaacatcgcgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcaccgacaacgggaagaccatcatcgtgcacctgaacgagtccgtgaagatcgagtgcacccgcccgtcgaacaacacgcgcacctccatccggatcggccctggccaggccttctacgccaccggccaggtgatcggcaacatccgcgaggcgcactgcaacatctcggagtccaagtggaacgagaccctgcagcgcgtgtccaagaagctgaaggagtacttccccgacaagaacatcacgttccagccgtcgtccggcggcgacctcgagatcaccacgcactccttcagctgcggtggcgagttcttctactgcaacacgtcgtcgctgttcaaccgcacctacatggccacgaacaccgacatggccaactccaccgagaccaactccacgcgcatcatcacgatccgctgccgcatccggcagatcatcaacatgtggcaggaggtgggccgcgccatgtacgcaccgcccatcgccggcaacatcacctgcatctccaacatcaccggcctcctgctgacccgcgacggcggcgagaacaacacggagaccttcgagacgttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagctcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtgaccgggtcctggatccagatctgctgtgcctt

SEQ ID NO: 573 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaagaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtgaccgaattcgggacccggatccagatctgctgtgcctt

SEQ ID NO: 574 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtcaccgaattcgggacccggatccagatctgctgtgcctt

SEQ ID NO: 575 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaactcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtaaccgaattcgggacccggatccagatctgctgtgcctt

SEQ ID NO: 576 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaactcggcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggttaccgaattcgggacccggatccagatctgctgtgcctt

SEQ ID NO: 577 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtgaccgaattcgggtcccggatccagatctgctgtgcctt

SEQ ID NO: 578 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtgaccgaattcaggacccggatccagatctgctgtgcctt

SEQ ID NO: 579 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtgaccgaattcaggtcccggatccagatctgctgtgcctt

SEQ ID NO: 580 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtgaccgaattcgggacctggatccagatctgctgtgcctt

SEQ ID NO: 581 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaactcggggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtgaccgaattcgggtcctggatccagatctgctgtgcctt

SEQ ID NO: 582 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacacggcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtcaccgaattcgggtcccggatccagatctgctgtgcctt

SEQ ID NO: 583 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaagaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtcaccgaattcgggacctggatccagatctgctgtgcctt

SEQ ID NO: 584 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtcaccgaattcgggtcctggatccagatctgctgtgcctt

SEQ ID NO: 585 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcatcaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtaaccgaattcaggtcccggatccagatctgctgtgcctt

SEQ ID NO: 586 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcaagatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtaaccgaattcgggtcctggatccagatctgctgtgcctt

SEQ ID NO: 587 - DNA, 2168 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacacgaacgccacggcctcgaactcctccacgatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcaacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggattcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggcgaaccgcgtgcgccagggctgatgaggttaccgaattcgggtcccggatccagatctgctgtgcctt

SEQ ID NO: 588 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgaacaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtcaccgaattcaggacccggatccagatctgctgtgcctt

SEQ ID NO: 589 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgaacaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcaacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggttaccgaattcaggtcccggatccagatctgctgtgcctt

SEQ ID NO: 590 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccacgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatccggaacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcaagatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggttaccgaattcgggtcctggatccagatctgctgtgcctt

SEQ ID NO: 591 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccacgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaacaacacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggacccgaattcggtaaccggatccagatctgctgtgcctt

SEQ ID NO: 592 - DNA, 2162 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacgccacggcctcgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcaagtccatccggatcggccctggccaggccttctacgccaccggccaggtgatcggcgacatccgcgaggcgtactgcaacatctccgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggacccgaattcggttaccggatccagatctgctgtgcctt

SEQ ID NO: 593 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccacgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgcggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggtcccgaattcggtgaccggatccagatctgctgtgcctt

SEQ ID NO: 594 - DNA, 2148 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccacgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcaaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaacaacacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccggggctgatgagaggacccgaattcggtgaccggatccagatctgctgtgcctt

SEQ ID NO: 595 - DNA, 2148 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccacgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcaaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaggtcccgaattcggtgaccggatccagatctgctgtgcctt

SEQ ID NO: 596 - DNA, 2165 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacggccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtccagctcaacgagtccgtgaagatcgagtgcacccgcccgaacaacaagacgcgcacctccatccggatcggccctggccaggccttctacgccaccggccaggtgatcggcaacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacaccgacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggtcctgaattcggtgaccggatccagatctgctgtgcctt

SEQ ID NO: 597 - DNA, 2165 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgagcaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaaggtgttcatcatgatcgtgggcggcctgatcggcctgcgcatcatcttcgccgtgctgtcgctggtgaaccgcgtgcgccagggctgatgagggtcccgaattcggtcaccggatccagatctgctgtgcctt

SEQ ID NO: 598 - DNA, 2166 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacggcgaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgcactgcaacatcagcgagtccaagtggaacaagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacaccgacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaggacccgaattcggtcaccggatccagatctgctgtgcctt

SEQ ID NO: 599 - DNA, 2148 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccacgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgaacaacaacacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaggtcccgaattcggtcaccggatccagatctgctgtgcctt

SEQ ID NO: 600 - DNA, 2135 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaagggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacatctccatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaacaactccaccgagaccaactccacgcgcaccatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacaccgacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggacctgaattcggtcaccggatccagatctgctgtgcctt

SEQ ID NO: 601 - DNA, 2162 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacgccacggcctcgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcaagtccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggacccgaattcggtgaccggatccagatctgctgtgcctt

SEQ ID NO: 602 - DNA, 2168 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggggctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacggcctccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgcactgcaacatcagcgagtccaagtggaacgagaccctgcagcgcgtgtccaagaagctgaaggagtacttcccccaccagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggtcccgaattcggtaaccggatccagatctgctgtgcctt

SEQ ID NO: 603 - DNA, 2163 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcagctgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatcaaggaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaacatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaggacccgaattcggtaaccggatccagatctgctgtgcctt

SEQ ID NO: 604 - DNA, 2160 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacggccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacccggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcctcggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaggtcccgaattcggtaaccggatccagatctgctgtgcctt

SEQ ID NO: 605 - DNA, 2180 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacacgagggacggaggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggtcctgaattcggtaaccggatccagatctgctgtgcctt

SEQ ID NO: 606 - DNA, 2159 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgacgaacgccaccgcgtccaactcgtccatcatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacacggcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcgagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggtcccgaattcggttaccggatccagatctgctgtgcctt

SEQ ID NO: 607 - DNA, 2169 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacggcctccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgggaagaccatcatcgtgcacctgaacgagtccgtgaagatcgagtgcacccgcccgagcaacaagacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacaccgacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaggacccgaattcggttaccggatccagatctgctgtgcctt

SEQ ID NO: 608 - DNA, 2166 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgcactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacaccgacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaacaacctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaggtcccgaattcggttaccggatccagatctgctgtgcctt

SEQ ID NO: 609 - DNA, 2168 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacggccagcaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcaacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacaccgacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggacctgaattcggttaccggatccagatctgctgtgcctt

SEQ ID NO: 610 - DNA, 2165 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacggccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcaagatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacaccgacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggctcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtgaccgggacccggatccagatctgctgtgcctt

SEQ ID NO: 611 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaacgccaccgcgtccaactcctccatcctcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtcaccgggacccggatccagatctgctgtgcctt

SEQ ID NO: 612 - DNA, 2147 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaacgccaccgcgtccaactcctccatcctcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcgagaacaacacggagaccttcgagacgttcaggccaggcggaggcaacatgaaggacaactggcgctccgagctgtacaagtacaaggtggtggaggtgaagcccctgggcgtggcacccaccaacgcccgcaggcgcgcggtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtaaccgggacccggatccagatctgctgtgcctt

SEQ ID NO: 613 - DNA, 2186 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaacgccaccgcgtccaactcctctatcatcgaggggatgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacgtccaccgacatggccaactccaccgagaccaactccacgcgcatcatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtgaccgggtcccggatccagatctgctgtgcctt

SEQ ID NO: 614 - DNA, 2186 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcaccgacgccaccgcgtccaacgcaaccgcgagcaacgccacggcgtcgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagaacaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtgaccaggacccggatccagatctgctgtgcctt

SEQ ID NO: 615 - DNA, 2153 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccgacgccaccgcgtccaacgcaaccgcgatcaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtgaccaggtcccggatccagatctgctgtgcctt

SEQ ID NO: 616 - DNA, 2186 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcctgtggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcaccgacgccaccgcgtccaacgcaaccgcgagcaacgccacggcgtcgaactcgtccatcaacagctccatcatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgcgatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgaggtcacgacgcactccttcaactgcggtggcgagttcttctactgcaacacgtcgtcgctgttcaaccgcaccgacatggccaactccaccgagaccaactccacgcgcatcatcaccatccgctgccgcatcaagcagatcgtcaacatgtggcaggaggtgggccgcgccatgtacgcaccgcccatcgccggcaacatcacctgcatctccaacatcaccggcctcctgctgacccgcgacggcggcgagaacaacggcgggaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatcggcctgcgcatcatcttcgccgtgctgtcgctggtgaaccgcgtgcgccagggctgatgagaattcggtcaccgggtcccggatccagatctgctgtgcctt

SEQ ID NO: 617 - DNA, 2186 bp, Artificial Sequence
  Description of Artificial Sequence: Synthetic polynucleotide
gtcgacaagaagccaccatgcgcgtgatgggcatccagcgcaactacacgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgtgaacgccaccgcgtccaactcctctatcatcgaggggatgaactcgtccatcctcgagggcatgaagaactgctccttcaacatcacgacggagctgcgcgacaagcgcgagaagaagaacgccctgttctacaagctggacatcgtgcagctggggggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatcagcgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcgagaacaacacggagaccttcgagacgttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagctgatctacgagctcctcgaggagtcccagaaccagcaggagaagaacgagcaggatctgctcgcgctggaccgctggaactccctctgggactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtcaccaggacccggatccagatctgctgtgcctt

SEQ ID NO: 618 - DNA, 2198 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcctgtggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccgacgccaccgcgtccaacgcaaccgcgagcaacgccacggcgtcgaacgcgaccgcgtcgaactcctccatcatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatcagcgagtccaagtggaacgagaccctgcagcgcgtgtccaagaagctgaaggagtacttcccccagaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaaccgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatgatctacgagctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatctgcctgcgcatcatcttcgccgtgctgtcgctggtgaaccgcgtgcgccagggctgatgagaattcggtcaccaggtcccggatccagatctgctgtgcctt

SEQ ID NO: 619 - DNA, 2168 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcgacgccaccgcgtccaacgcgacggcgatcaacatctccatcatcgaggagatgaagaactgctccttcaacatcacgacggagctgcgcgacaagcgcgagaagaagaacgccctgttctacaagctggacatcgtgcagctggacggcaactcctcgcagcacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacctccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacaccgacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtcaccgggacctggatccagatctgctgtgcctt

SEQ ID NO: 620 - DNA, 2165 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctggactgcatcaacgccaccaacgcgacggcgtcgaactcctccatcctcgaggggatgaagaactgctccttcaacatcacgacggagctgcgcgacaagcgcgagaagaagaacgccctgttctacaagctggacatcgtgcagctggggggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccaagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggtgaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcgagaacaacaccgagacgttcgagaccttcaggccagggggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagctcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtaaccgggtcccggatccagatctgctgtgcctt

SEQ ID NO: 621 - DNA, 2198 bp, Artificial Sequence
  Description of Artificial Sequence: Synthetic polynucleotide
gtcgacaagaagccaccatgcgcgtgatgggccgccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgacgccctgcgtgaagctgaccccgctgtgcgtgaccctgaactgcaccgacgccaccgcatccaacgcgacggcttccaacgccacggcgtcgaacgcgacagcgtcgaactcgtctatcgaggggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccgagaagctgaaggagtacttccccaacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacaccgagacgttcgagaccttcaggccagggggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatgatctacgagctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatcggcctgcgcatcatcttcgccgtgctgtcgctggtgaaccgcgtgcgccagggctgatgagaattcggtaaccaggacccggatccagatctgctgtgcctt

SEQ ID NO: 622 - DNA, 2153 bp, Artificial Sequence
  Description of Artificial Sequence: Synthetic polynucleotide
gtcgacaagaagccaccatgcgcgtgacgggcatccagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcatcgacgccaacgcgaccgcgtccaacgcgacggcatccaactcgtccatcatcgaggggatgaagaactgctccttcaacatcacgacggagctgcgcgacaagatcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcacgatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacaccacggagaccttcaggccagggggaggcaacatgaaggacaactggcgctccgagctgtacaagtacaaggtggtggagatcaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccgactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtaaccaggtcccggatccagatctgctgtgcctt

SEQ ID NO: 623 - DNA, 2168 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcgacgccaccgcgtccaacgcgacggcgatcaacatctccatcatcgaggagatgaagaactgctccttcaacatcacgacggagctgcgcgacaagcgcgagaagaagaacgccctgttctacaagctggacatcgtgcagctggacggcaactcctcgcagcacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccaagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacctccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacaccgacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtaaccgggacctggatccagatctgctgtgcctt

SEQ ID NO: 624 - DNA, 2183 bp, Artificial Sequence
  Description of Artificial Sequence: Synthetic polynucleotide
gtcgacaagaagccaccatgcgcgtgatgggcatccagaagaactgcccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcacggacgccaacgcaaccgcgtccaactcgtccatcatcaaggggatgaactcgtccatgatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccaagaagctgaaggagtacttcccccagaaggacatcaccttccagccgtcgtccggcggcgacctcgagatcaccacgcactccttcaactgcggtggcgagttcttctactgcaacacgtcgtcgctgttcaaccgcacctacatggccacctccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcgagaacgacaccgacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtaaccgggtcctggatccagatctgctgtgcctt

SEQ ID NO: 625 - DNA, 2162 bp, Artificial Sequence
  Description of Artificial Sequence: Synthetic polynucleotide
gtcgacaagaagccaccatgcgcgtgatgggcatccagcgctcgtacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgcgcctgaccccgctgtgcgtgaccctgaactgcatcaacgccaccaacgcgacggcgtcgaactcctccatcctcgaggggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgaacctgttcaaccgcacctacatggtgaactccaccgacatggccaactccaccgagaccaactccacgcgcaccatcacgatcagctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacaccgacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggttaccgggtcccggatccagatctgctgtgcctt

SEQ ID NO: 626 - DNA, 2159 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcaacgccaccaacgcgacggcgtcgaactcctccatcctcgaggggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttcccccagaagaacatcaccttccagccgtcgtccggcggcgacctcgagatcaccacgcactccttcaactgcggtggcgagttcttctactgcaacacgtcgtccctgttcaaccgcacctacatggcgacctccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaacgacaccgacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggttaccaggacccggatccagatctgctgtgcctt

SEQ ID NO: 627 - DNA, 2162 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcacggacgccaccaacgcgacggcgtcgaactcctccatcctcggcgggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgcgatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggcgaactccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacaccgacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagctgatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggttaccaggtcccggatccagatctgctgtgcctt

SEQ ID NO: 628 - DNA, 2159 bp, Artificial Sequence
  Description of Artificial Sequence: Synthetic polynucleotide
gtcgacaagaagccaccatgcgcgtgcgcggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgcgcctgaccccgctgtgcgtgaccctgaactgcatcaacgccaccaacgcgacggcgtcgaactcctccatcctcgaggggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggcgaactccaccgacatggccaactccaccgagaccaactccacgcgcatcatcacgctgcactgccgcatcaagcagatcatcaacatgtggcaggaggtgggccgcgccatgtacgcaccgcccatcgccggcaacatcacctgcatctccaacatcaccggcctcctgctgacccgcgacggcggcaacgacaccgacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggttaccgggacctggatccagatctgctgtgcctt

SEQ ID NO: 629 - DNA, 2198 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggcgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcacggacgccaacgccaccgcgtcgaacgccaacgcgaccgcaagcaacaccaacgcgacggtgtcgaactcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaagtgatcggcgacatccgcaaggcgcactgcaacatctccgagtccaagtggaacgagaccctgcagcgcgtgtccaagaagctgaaggagtacttcccccacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctgcactgccgcatcaagcagatcatcaacatgtggcaggaggtgggccgcgccatgtacgcaccgcccatcgccggcaacatcacctgcatctccaacatcaccggcctcctgctgacccgcgacggcggcgagaacacccgggacggaggcaacaacaacacggagaccttcaggccagggggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgacatcatctacgacctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatcggcctgcgcatcatcttcgccgtgctgtcgctggtgaaccgcgtgcgccagggctgatgagaattcggttaccgggtcctggatccagatctgctgtgcctt

SEQ ID NO: 630 - DNA, 2177 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcctctggatgctcatgatctgcaacggcatgtgggtgacggtgtactacggcgtgccggtgtggaagaaggccaagacgaccctgttctgcgcgtcggacgccaaggcctacgagaaggaggtgcacagcgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcacggacgccaacgccaccgcgtcgaacagctccatcatcaaggggatgaactcgtccatgatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttccccgaccggaacatcaccttccagccgtcgtccggcggcgaccccgagatcaccacgcactccttcaactgcggtggcaagttcttctactgcaacacgtcgtccctgttcaaccgcacctacatggccaactcgacggacatggcgaactccaccgagaccaactccacgcgcatcatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggaggcaacaacaacacggagaccttcaggccagtgggaggcaacatgaaggacaactggcgctccaagctgtacaagtacaaggtggtggaggtgaagcccctgggcgtggcacccaccaaggcccgcaggcgcatggtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgacctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatcggcctgaagatcatcttcgccgtgctgtcgctggtgaaccgcgtgcgccagggctgatgaggtgaccgggacccgaattcggatccagatctgctgtgcctt

SEQ ID NO: 631 - DNA, 2198 bp, Artificial Sequence
  Description of Artificial Sequence: Synthetic polynucleotide
gtcgacaagaagccaccatgaaggtgcggggcatccagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctggagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcacggacgccaacgccaccgcgtcgaacaccaacgcgaccgcaagcaacatcaacgcgacggcgtcgaagtcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacagcaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctgcactgccgcatcaagcagatcatcaacatgtggcaggaggtgggccgcgccatgtacgcaccgcccatcgccggcaacatcacctgcatctccaacatcaccggcctcctgctgacccgcgacggcggcgagaacacccgggacggaggcaacaacaacacggagaccttcaggccagagggaggcaacatgaaggacaactggcgctccgagctgtacaagtacaaggtggtggaggtgaagcccctgggcgtggcacccaccaaggcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgacatcatctacgacctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatcggcctgcgcatcatcttcgccgtgctgtcgctggtgaaccgcgtgcgccagggctgatgaggtaaccgggacccgaattcggatccagatctgctgtgcctt

SEQ ID NO: 632 - DNA, 2177 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcacggacgccaacgccaccgcttcgaacatcaacgcgacggcgtcgaagtcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacagcaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctgcactgccgcatcaagcagatcatcaacatgtggcaggaggtgggccgcgccatgtacgcaccgcccatcgccggcaacatcacctgcatctccaacatcaccggcctcctgctgacccgcgacggcggcgagaacacccgggacggaggcaacaacaacacggagaccttcaggccagagggaggcaacatgaaggacaactggcgctccgagctgtacaagtacaaggtggtggaggtgaagcccctgggcgtggcacccaccaaggcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggttaccgggacccgaattcggatccagatctgctgtgcctt

SEQ ID NO: 633 - DNA, 2210 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcctctggatgctcatgacctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcacggacgccaacgccaccgcgtcgaacacgaacgcgaccgcaagcaacatcaacgcgacggcgtcgaagtcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagtcctcgtccggcggcgaccccgagatcaccacgcactccttcaactgcggtggcgagttcttctactgcaacacgtcgtccctgttcaaccgcacctacatggcgaactcgacggacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcgagaacaacggaggcaagaacaacacggagaccttcaggccagggggaggcaacatgaaggacaactggcgctccgagctgtacaagtacaaggtggtggaggtgaagcccctgggcgtggcacccaccaaggcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgacatcatctacgacctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatcggcctgcgcatcatcttcgccgtgctgtcgctggtgaaccgcgtgcgccagggctgatgaggtgaccgggtcccgaattcggatccagatctgctgtgcctt

SEQ ID NO: 634 - DNA, 2180 bp, Artificial Sequence
  Description of Artificial Sequence: Synthetic polynucleotide
gtcgacaagaagccaccatgcgcgtgcgcggcatccagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggcgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcacggacgccaacgccaccgcgtcgaacacgaacgcgaccgtcagcaacatcaaggcgacggtgtcgaactcctccatcatcgaggagatgaagaactgctccttcaacatcacgacggagctgcgcgacaagatcgagaagaagtacgccctgttctacaagctggacatcgtgcagctggacggcaactccacgcagtaccgcttcatcaactgcaacacctccgcgatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacgggaagaccatcatcgtgcacctgaacgagtccgtgaagatcgagtgcacccgcccggggaacaacacgcgcacctccatccggatcggccctggccaggccttctacgccaccggccaagtgatcggcgacatccgccaggcgcactgcaacatctccgagtccaagtggaacgagaccctgcagcgcgtgtccgagaagctgaaggagtacttccccaacaagacgatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaacacgaccgacatcgagaccttcaggccagggggaggcaacatgaaggacaactggcgctccgagctgtacaagtacaaggtggtggaggtgaagcccctgggcgtggcacccaccaaggcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagcgcgagatctccaactacaccgagatcatctacgacctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatcggcctgcgcatcatcttcgccgtgctgtcgctggtgaaccgcgtgcgccagggctgatgaggtgaccaggacccgaattcggatccagatctgctgtgcctt

SEQ ID NO: 635 - DNA, 2186 bp, Artificial Sequence
  Description of Artificial Sequence: Synthetic polynucleotide
gtcgacaagaagccaccatgcgcgtgcgcggcatccagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggcgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcacggacgccaacgccaccgcgtcgaacgccaacgcgaccgccagcaacacgaacgcgacggtgtcgaacgactcctccatcatcgaggagatgaagaactgctccttcaacatcacgacggagctgcgcgacaagatcgagaagaagtacgccctgttctacaagctggacatcgtgcagctggacggcaactccacgcagtaccgcttcatcaactgcaacacctccgcgatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaacaccatcatcgtgcacctgaacgagtccgtgaagatcgagtgcacccgcccgtccaacaacacgcgcacctccatccggatcggccctggccaggccttctacgccaccggccaagtgatcggcgacatccgccaggcgcactgcaacatctccgagtccaagtggaacgagaccctgcagcgcgtgtccgagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaactcgtccaaggagaccgagaccttcaggccagggggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgcggctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctactcggacatctgggacaacatgacctggatgcagtgggagggggagatctccaactacaccgagatcatctacaacctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatcggcctgcgcatcatcttcgccgtgctgtcgctggtgaaccgcgtgcgccagggctgatgaggtgaccaggtcccgaattcggatccagatctgctgtgcctt

SEQ ID NO: 636 - DNA, 2162 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagacgttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaagaagtacttccccgacaagaacatcaccttccggccgtcgtccggcggcgacctcgagatcaccacgcactccttcaactgcggtggcgagttcttctactgcaacacgtcgtccctgttcaaccgcacctacatggcgacctccacggacatggccaactccaccgagacgaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagcgcgagatctccaactacaccaacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgggtgcgccagggctgatgaggtgaccgggacctgaattcggatccagatctgctgtgcctt

SEQ ID NO: 637 - DNA, 2165 bp, Artificial Sequence
  Description of Artificial Sequence: Synthetic polynucleotide
gtcgacaagaagccaccatgcgcgtgatgggcacccagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgtactgcatcaacgccaccgccaacgcgacggtctcgaactcctcgatcatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgcgatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgccaggcgcactgcaacatctccgagtccaagtggaacgagaccctgcagcgcgtgtccgagaagctgaaggagtacttccccaacaagacgatcaccttccagccgtcgtccggcggcgaccccgagatcaccacgcactccttcaactgcggtggcgagttcttctactgcaacacgtcgtccctgttcaaccgcacctacatggcgaactccaccgacatggccaactccaccgagacgaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaacagctccaaggagacggagaccttcaggccagggggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggggacatctgggacaacatgacctggatgcagtgggagcgcgagatctccaactacaccgacctcatctacgacctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatcggcctgcgcatcatcttcgccgtgctgtcgctggtgaaccgcgtgcgccagggctgatgaggtgaccgggtcctgaattcggatccagatctgctgtgcctt

SEQ ID NO: 638 - DNA, 2162 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaagaagtacttccccgacaagaacatcaccttccggccgtcgtccggcggcgacctcgagatcaccacgcactccttcaactgcggtggcgagttcttctactgcaacacgtcgtccctgttcaaccgcacctacatggcgacgtccaccgacatggccaactccaccgagacgaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagcgcgagatctccaactacaccaacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtcaccgggtcccgaattcggatccagatctgctgtgcctt

SEQ ID NO: 639 - DNA, 2162 bp, Artificial Sequence
  Description of Artificial Sequence: Synthetic polynucleotide
gtcgacaagaagccaccatgcgcgtgatgggcatccagcgcagctacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgagctgcatcaacgccaccaacgcgacggactcgaacaactccatcctcgaggggatgaagaactgctccttcaacatcacgacggagctgcgcgacaagcgcgagaagaagaacgccctgttctacaagctggacatcgtgcagctgtacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggcgacgtccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacagcgacatctgggacaacatgacctggatgcagtgggagcgcgagatctccaactacaccgacatgatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtcaccaggacccgaattcggatccagatctgctgtgcctt

SEQ ID NO: 640 - DNA, 2162 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggacggagaccctgcagcgcgtgtccgagaagctgaagaagtacttccccgacaagaacatcaccttccggccgtcgtccggcggcgacctcgagatcaccacgcactccttcaactgcggtggcgagttcttctactgcaacacgtcgtccctgttcaaccgcacctacatggcgacgtccaccgacatggccaactccaccgagatcaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagcgcgagatctccaactacaccaacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtcaccaggtcccgaattcggatccagatctgctgtgcctt

SEQ ID NO: 641 - DNA, 2183 bp, Artificial Sequence
  Description of Artificial Sequence: Synthetic polynucleotide
gtcgacaagaagccaccatgcgcgtgatgggccggcagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgacgccctgcgtgaagctgaccccgctgtgcgtgaccctgaactgcacggacgccaacgacaccgcgtcgaacagctccatcatcaaggggatgaacaactccatcgtgggggagatgaagaactgctccttcaacatcacgacggagctgcgcgacaagcgcgagaagaagaacgccctgttctacaagctggacatcgtgcagctggacggcaactcctcggagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggccaactcgacggacatggcgaactccgcggagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggaggcaactccagcacggagacggagaccttcaggccagggggaggcaacatgaaggacaactggcgctccgagctgtacaagtacaaggtggtggaggtgaagcccctgggcgtggcacccaccaacgcccgcaggcgcgtggtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgcggctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagggggagatctccaactacaccaacatcatctacgacctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcggatcatcttcgccgtgctgtcgctggtgaaccgcgtgcgccagggctgatgaggtcaccgggacctgaattcggatccagatctgctgtgcctt

SEQ ID NO: 642 - DNA, 2162 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcatgtgggtgacggtgtactacggcgtgccggtgtggcgggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccaagaagctgaagaagtacttccccgacaagaacatcaccttccggccgtcgtccggcggcgacctcgagatcaccacgcactccttcaactgcggtggcgagttcttctactgcaacacgtcgtccctgttcaaccgcacctacatggcgacgtccatcgacatggccaactccaccgagacgaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagcgcgagatctccaactacaccaacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaacaaagtgcgccagggctgatgaggtcaccgggtcctgaattcggatccagatctgctgtgcctt

SEQ ID NO: 643 - DNA, 2162 bp, Artificial Sequence
  Description of Artificial Sequence: Synthetic polynucleotide
gtcgacaagaagccaccatgcgcgtgcgcggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcaacgccaccaacgcgacggcgtcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggcgaactccacggacatggccaactccaccgagacgaactccacgcgcatcatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacagcgacatctgggacaacatgacctggatgcagtgggagcgcgagatctccaactacaccgacatgatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgggtgcgccagggctgatgaggtaaccgggtcccgaattcggatccagatctgctgtgcctt

SEQ ID NO: 644 - DNA, 2162 bp, Artificial Sequence
  Description of Artificial Sequence: Synthetic polynucleotide
gtcgacaagaagccaccatgcgcgtgcgcggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaagaagtacttccccgacaagaacatcaccttccggccgtcgtccggcggcgacctcgagatcaccacgcactccttcaactgcggtggcgagttcttctactgcaacacgtcgtccctgttcaaccgcacctacatggcgacctccacggacatggccaactccaccgagacgaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagcgcgagatctccaactacaccaacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgggtgcgccagggctgatgaggtaaccaggacccgaattcggatccagatctgctgtgcctt

SEQ ID NO: 645 - DNA, 2162 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaaggcgttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaagaagtacttccccgacaagaacatcaccttccggccgtcgtccggcggcgacctcgagatcaccacgcactccttcaactgcggtggcgagttcttctactgcaacacgtcgtccctgttcaaccgcacctacatggcgacctccacggacatggccaactccaccgagacgaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagcgcgagatctccaactacaccaacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgggtgcgccagggctgatgaggtaaccaggtcccgaattcggatccagatctgctgtgcctt

SEQ ID NO: 646 - DNA, 2159 bp, Artificial Sequence
  Description of Artificial Sequence: Synthetic polynucleotide
gtcgacaagaagccaccatgcgcgtgcgcggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaagtccaacatcctcgaggggatgaagaactgctccttcaacatcacgacggagctgcgcgacaagcgcgagaagaagaacgccctgttctacaagctggacatcgtgcagctgggcgggaactccaacagctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttcccccagaagaacatcaccttccagccgtcgtccggcggcgacctcgagatcaccacgcactccttcaactgcggtggcgagttcttctactgcaacacgtcgtccctgttcaaccgcacctacatggcgacgggcaccgacatggccaactccaccgagacgaacatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaactccacggaggacacggagaccttcaggccagtgggaggcaacatgaaggacaactggtcgtccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagcgcgagatctccaactacaccaacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtaaccgggacctgaattcggatccagatctgctgtgcctt

SEQ ID NO: 647 - DNA, 2162 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcatcaacgccaccaacgcgacggcctcggactcctcgatcctcgacgggatgaagaactgctccttcaacatcacgacggagctgcgcgacaagcgcgagaagaagaacgccctgttctacaagctggacatcgtgcagctgggctccaacagctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttccccgacaagaagatcaccttccagccgtcgtccggcggcgacctcgagatcaccacgcactccttcaactgcggtggcgagttcttctactgcaacacgtcgtccctgttcaaccgcacctacatggcgaacagcaccgacatggccaactccaccgagacgaactcgacgcagatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagtgggaggcaacatgaaggacaactggtcgtccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtaaccgggtcctgaattcggatccagatctgctgtgcctt

SEQ ID NO: 648 - DNA, 2162 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaagtccaacatcctcgaggggatgaagaactgctccttcaacatcacgacggagctgcgcgacaagcgcgagaagaagaacgccctgttctacaagctggacatcgtgcagctgggcgggaacagctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggcgaacagcaccgacatggccaactccaccgagacgaactcgacgcagatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagtgggaggcaacatgaaggacaactggtcgtccgagctgtacaagtacaaggtggtggaggtgaagcccctgggcgtggcacccaccaaggcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagcgcgagatctccaactacaccaacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggttaccgggtcccgaattcggatccagatctgctgtgcctt

SEQ ID NO: 649 - DNA, 2153 bp, Artificial Sequence
  Description of Artificial Sequence: Synthetic polynucleotide
gtcgacaagaagccaccatgcgcgtgcgcggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgcggctgaccccgctgtgcgtgaccctgaactgcatcaacgccaccaacgcgacggcctcggactccagcatcctcgacgggatgaagaactgctccttcaacatcacgacggagctgcgcgacaagcgcgagaagaagaacgccctgttctacaagctggacatcgtgcagctgggcgggaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaagaagtacttccccgacaagaacatcaccttccagccgtcgtccggcggcgacctcgagatcaccacgcactccttcaactgcggtggcgagttcttctactgcaacacgtcgtccctgttcaaccgcacctacatggcgacgtccaccgacctcgccaactccaccgagacgaacatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagtgggaggcaacatgaaggacaactggtcgtccgagctgtacaagtacaaggtggtggaggtgaagcccctgggcgtggcacccaccaacgcccgcaggcgcgtcgtgaagagggagaagcgcgccgtgggcatgggcgccatgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagcgcgagatctccaactacaccgagctcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggttaccaggacccgaattcggatccagatctgctgtgcctt

SEQ ID NO: 650 - DNA, 2198 bp, Artificial Sequence
  Description of Artificial Sequence: Synthetic polynucleotide
gtcgacaagaagccaccatgcgcgtgatgggcaggcagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaagggctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcacggacgccaacgccaccgcgtcgaacgccaacgcgaccgtgagcaacacgaacgcgacggtgtcgaacgactcctccatcatcgaggagatgaagaactgctccttcaacatcacgacggagctgcgcgacaagatcgagaagaagtacgccctgttctacaagctggacatcgtgcagctggacggcaactccacgcactaccgcttcatcaactgcaacacctccgcgatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgtccaacaacacgcgcacctccatcgggatcggccctggccaggccttctacgccaccggccaggtcatcggcgacatccgcaaggcgcactgcaacatctccgagtccaagtggaacgagaccctgcagcgcgtgtccaagaagctgaaggagtacttccccggcaagaacatcaccttccagccgtcgtccggcggcgaccccgaagtgaccacgcactccttcaactgcggtggcgagttcttctactgcaacacgtcgtccctgttcaaccgcacctacatgacgaacagcacggacatggcgaactccaccgagaccaaccgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaactcgtccacggagaccgagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgcggctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagggggagatctccaactacaccaacatcatctacgacctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatcggcctgcgcatcatcttcgccgtgctgtcgctggtgaaccgcgtgcgccagggctgatgaggttaccaggtcccgaattcggatccagatctgctgtgcctt

SEQ ID NO: 651 - DNA, 2162 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaagtccaacatcctcgaggggatgaagaactgctccttcaacatcacgacggagctgcgcgacaagcgcgagaagaagaacgccctgttctacaagctggacatcgtgcagctgggctccaacagctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggcgaacagcaccgacatggccaactccaccgagacgaactcgacgcagatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagtgggaggcaacatgaaggacaactggtcgtccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagcgcgagatctccaactacaccaacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggttaccgggacctgaattcggatccagatctgctgtgcctt

SEQ ID NO: 652 - DNA, 2153 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgcggctgaccccgctgtgcgtgaccctgaactgcatcaacgccaccaacgcgacggcctcggactccagcatcctcgacgggatgaagaactgctccttcaacatcacgacggagctgcgcgacaagcgcgagaagaagaacgccctgttctacaagctggacatcgtgcagctgggcgggaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaagaagtacttccccgacaagaacatcaccttccagccgtcgtccggcggcgacctcgagatcaccacgcactccttcaactgcggtggcgagttcttctactgcaacacgtcgtccctgttcaaccgcacctacatggcgacgtccaccgacatggccaactccaccgagacgaacatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagtgggaggcaacatgaaggacaactggtcgtccgagctgtacaagtacaaggtggtggaggtgaagcccctgggcgtggcacccaccaacgcccgcaggcgcgtcgtggagagggagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacagcgacatctgggacaacatgacctggatgcagtgggagcgcgagatctccaactacaccgacatgatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggttaccgggtcctgaattcggatccagatctgctgtgcctt

SEQ ID NO: 653 - DNA, 2155 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcatcaacgccaccaacgcgacggcctcggactccagcatcctcgacgggatgaagaactgctccttcaacatcacgacggagctgcgcgacaagcgcgagaagaagaacgccctgttctacaagctggacatcgtgcagctgggcagcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggcgaactccaccgacatggccaactccaccgagacgaacagcacgcagatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagtgggaggcaacatgaaggacaactggtcgtccgagctgtacaagtacaaggtggtggaggtgaagcccctgggcgtggcacccaccaacgcccgcaggcgcgtcgtggagagggagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtgaccgaattcggatccagatctgctgtgcctt

SEQ ID NO: 654 - DNA, 2155 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcatcaacgccaccaacgcgacggcctcggactccagcatcctcgacgggatgaagaactgctccttcaacatcacgacggagctgcgcgacaagcgcgagaagaagaacgccctgttctacaagctggacatcgtgcagctgggcgggaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaaggagtacttccccgacaagaacatcaccttccagccgtcgtccggcggcgacctcgagatcaccacgcactccttcaactgcggtggcgagttcttctactgcaacacgtcgtccctgttcaaccgcacctacatggcgaactccaccgacatggccaactccaccgagacgaacagcacgcagatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagtgggaggcaacatgaaggacaactggtcgtccgagctgtacaagtacaaggtggtggaggtgaagcccctgggcgtggcacccaccaacgcccgcaggcgcgtcgtggagagggagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacagcgacatctgggacaacatgacctggatgcagtgggagcgcgagatctccaactacaccgacatgatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtcaccgaattcggatccagatctgctgtgcctt

SEQ ID NO: 655 - DNA, 2188 bp, Artificial Sequence
  Description of Artificial Sequence: Synthetic polynucleotide
gtcgacaagaagccaccatgcgcgtgatgggcaggcagcgcaactacccgcagtggtggatctggagcacgctgggcctcaggatgctcatgatctgcaacggcatgtgggtgacggtgtactacggcgtgccggtgtggaaggaggccaagacgaccctgttctgcgcgtcggacgccaaggcgtacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcacggacgccaacgccaccgcgtcgaacgccaacgcgaccgtgagcaacacgaacgcgacggtgtcgaacgactcctccatcatcgaggagatgaagaactgctccttcaacatcacgacggagctgcgcgacaagatcgagaagaagtacgccctgttctacaagctggacatcgtgcagctggacggcaactccacgcactaccgcttcatcaactgcaacacctccgcgatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacgcgaagaccatcatcgtgcacctgaacgagtccgtgaagatcgagtgcacccgcccgtccaacaacacgcgcacctccatcgggatcggccctggccaggccttctacgccaccggccaggtcatcggcgacatccgcaaggcgcactgcaacatctccgagtccaagtggaacgagaccctgcagcgcgtgtccaagaagctgaaggagtacttccccggcaagaacatcaccttccagccgtcgtccggcggcgaccccgaagtgaccacgcactccttcaactgcggtggcgagttcttctactgcaacacgtcgtccctgttcaaccgcacctacatgacgaacagcacggacatggcgaactccaccgagaccaaccgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaccccgagatcttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgcggctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagagcgagatcagcaactacaccaacatcatctacgacctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatcggcctgcgcatcatcttcgccgtgctgtcgctggtgaaccgcgtgcgccagggctgatgaggtaaccgaattcggatccagatctgctgtgcctt

SEQ ID NO: 656 - DNA, 2111 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgaacaactccaacatcatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagtggatccagatctgctgtgcctt

SEQ ID NO: 657 - DNA, 2171 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacggcccggaactgcacgaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacagcgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccagcatcaccggcctcctgctgacccgcgacggcggcgagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgttctcgctggtgaaccgcgtgcgccagggctgatgagggacctgaattcggtaaccggatccagatctgctgtgcctt

SEQ ID NO: 658 - DNA, 2582 bp, Artificial Sequence
  Description of Artificial Sequence: Synthetic polynucleotide
gtcgacaagaaatgagggtcaagggcatcaggaagaactaccagcacctctggaggtggggcacgatgctcctggggatgctgatgatctgcagcgcggctgagcagctgtgggtgaccgtgtactacggcgtgcctgtgtggcgggacgccgagaccaccctgttctgtgcctcggacgccaaggcctacgagcgggaggtccacaacgtgtgggctacccacgcctgtgtgcccaccgatcccaacccgcaggagatcgtcctggagaacgtgaccgaggagttcaacatgtggaagaacaacatggtggaccagatgcacgaggacatcatcagcctgtgggacgagagcctgaagccctgcgtgaagctgacccccctgtgtgtgaccctgaactgcacggacgtgaacgtgaccaagaccaactcgacgtcctgggggatgatggagaagggggagatcaagaactgtagcttcaacatgaccaccgagctgcgggacaagaagcagaaggtgtacgccctgttctacaagctggacatcgtgccgctggaggagaacgacaccatctccaacagcacctacaggctgatcaactgcaacaccagcgcgatcacccaggcctgccccaaggtcaccttcgagcccatccccatccactactgcacgcctgccggcttcgccatcctgaagtgcaacgacaagaagttcaacggcaccggcccctgcaagaacgtcagcaccgtccagtgcacccacggcatccggcctgtggtgacgacccagctgctcctgaacggcagcctggccgaggaggagatcatcatcaggagcgagaacctcaccaacaacgccaagacgatcatcgtgcagctgaacgagtcggtggtgatcaactgtacccggcccaacaacaacacccggaagagcatccggatcggccctggacagaccttctacgcgacgggcgacatcatcggcaacatcagacaggcccactgcaacatctcgcgggagaagtggatcaacaccacgagggacgtcaggaagaagctgcaggagcacttcaacaagaccatcatcttcaacagcagcagcggcggagacctggagatcaccacgcactcgttcaactgtcggggcgagttcttctactgcaacacatcgaagctgttcaacagcgtctggggcaacagctcgaacgtgacgaaggtgaacggcacgaaggtcaaggagacgatcacactgccctgcaagatcaagcagatcatcaacatgtggcaggaggtgggccgggctatgtacgcccctcccatcgcgggcaacatcacgtgcaagagcaacatcaccggcctgctcctagtgagagacggcggcaacgtcacgaacaacaccgagatcttcaggcctggcggcggaaacatgaaggacaactggcggagcgagctgtacaagtacaaggtcgtggagatcaagcccctgggcatcgcacccaccaaggccaagagaagggtggtggagcgggagaagagagcggtcggactgggcgccgtgttcctgggcttcctgggagcagccggaagcaccatgggagccgcctcgatgaccctgaccgtgcaggcgaggcagctgctgtccggcatcgtgcagcagcagtcgaacctgctgagggccatcgaggcccagcagcacatgctccagctgaccgtgtggggcatcaagcagctccaggcccgaatcctggccgtcgagcgctacctgcgggaccagcagctgctcggcatctggggctgtagcggcaagctgatctgtaccaccaacgtgccctggaacagcagctggagcaacaagagcctcgacgagatctggaacaacatgacctggatgcagtgggagaaggagatcgacaactacaccagcctcatctacacgctgatcgaggagagccagaaccagcaggagaagaacgagcaggacctgctggcgctggacaagtgggcgaacctgtggaactggttcgacatcagcaactggctgtggtacatccggatcttcatcatgatcgtcggcggcctgatcggtctgagaatcgtcttcgccgtgctgtccatcgtgaaccgagtgaggaagggctacagccccctgagcttccaaaccctgacgccgaacccgagaggccccgaccggctcgggaggatcgaggaggagggaggagagcaggacaaggacaggtccatcaggctcgtcaacggcttcctggcactcgcctgggacgacctgaggaacctgtgcctgttcagctaccaccggctgagggacctcctgctgatcgtcacccggatcgtcgagctgctgggccggagaggctgggaggccctgaagtacctgtggaacctgctccagtactggatacaggagctgaagaacagcgccgtgtccctgctgaacgccacggcgatcgcggtggccgagggaaccgaccgggtcatcgaggtggtgcagcgcgcctgcagggccatcctgcacatcccccggcgaatccgccagggcctggagcgcgccctgctctgatgaggatcc

SEQ ID NO: 659 - protein, 853 aa, Artificial Sequence
  Description of Artificial Sequence: Synthetic polypeptide
MRVKGIRKNYQHLWRWGTMLLGMLMICSAAEQLWVTVYYGVPVWRDAETTLFCASDAKAYEREVHNVWATHACVPTDPNPQEIVLENVTEEFNMWKNNMVDQMHEDIISLWDESLKPCVKLTPLCVTLNCTDVNVTKTNSTSWGMMEKGEIKNCSFNMTTELRDKKQKVYALFYKLDIVPLEENDTISNSTYRLINCNTSAITQACPKVTFEPIPIHYCTPAGFAILKCNDKKFNGTGPCKNVSTVQCTHGIRPVVTTQLLLNGSLAEEEIIIRSENLTNNAKTIIVQLNESVVINCTRPNNNTRKSIRIGPGQTFYATGDIIGNIRQAHCNISREKWINTTRDVRKKLQEHFNKTIIFNSSSGGDLEITTHSFNCRGEFFYCNTSKLFNSVWGNSSNVTKVNGTKVKETITLPCKIKQIINMWQEVGRAMYAPPIAGNITCKSNITGLLLVRDGGNVTNNTEIFRPGGGNMKDNWRSELYKYKVVEIKPLGIAPTKAKRRVVEREKRAVGLGAVFLGFLGAAGSTMGAASMTLTVQARQLLSGIVQQQSNLLRAIEAQQHMLQLTVWGIKQLQARILAVERYLRDQQLLGIWGCSGKLICTTNVPWNSSWSNKSLDEIWNNMTWMQWEKEIDNYTSLIYTLIEESQNQQEKNEQDLLALDKWANLWNWFDISNWLWYIRIFIMIVGGLIGLRIVFAVLSIVNRVRKGYSPLSFQTLTPNPRGPDRLGRIEEEGGEQDKDRSIRLVNGFLALAWDDLRNLCLFSYHRLRDLLLIVTRIVELLGRRGWEALKYLWNLLQYWIQELKNSAVSLLNATAIAVAEGTDRVIEVVQRACRAILHIPRRIRQGLERALL

SEQ ID NO: 660 - DNA, 2570 bp, Artificial Sequence
  Description of Artificial Sequence: Synthetic polynucleotide
gtcgacaagaaatgagggtcaaggagacgcagatgaactggccgaacctctggaagtggggcaccctgatcctgggcctcgtgatcatctgctccgcgagcgacaacctgtgggtgacggtgtactacggcgtgcctgtgtggaaggaggccaccaccaccctgttctgcgcctcggacgccaaggcctacgacacggaggtccacaacgtgtgggctacctacgcctgtgtgcccaccgatcccaaccctcaggaggtcgtgctgggcaacgtgaccgagaacttcaacatgtggaagaacaacatggtggagcagatgcacgaggacatcatcagcctgtgggaccagagcctgaagccctgcgtgcgcctgaccccgctgtgcgtgaccctgaactgctccaacgccaacaccacgaacaccaactcgacggaggagatcaagaactgcagcttcaacatcaccaccagcatccgggacaaggtgcagaaggagtacgccctgttctacaagctggacgtcgtgccgatcgacaacgacaacaccagctacaggctgatctcgtgcaacaccagcgtcatcacccaggcctgccccaaagttagcttcgagcccatccccatccactactgcgcgcctgccggcttcgccatcctgaagtgcaaggacaagaagttcaacggcaccggcccctgcacgaacgtcagcaccgtccagtgcacccacggcatcaggcctgtggtgtccacccagctgctcctgaacggcagcctggccgaggaggaggtcgtgatcaggagcgagaacttcaccaacaacgccaagacgatcatcgtgcacctgaacaagtcggtggagatcaactgcacccggcccaacaacaacacccggaagagcatccacatcggccctggacgggcgttctacgctacgggggagatcatcggcgacatcaggcaggcccactgcaacatctcgcgggccaagtggaacaacaccctgaagcagatcgtgaagaagctgaaggagcagttcaacaagaccatcatcttcaaccagagcagcggcggagacccggagatcaccacgcactcgttcaactgtggtggcgagttcttctactgtaacacgtccgggctgttcaacagcacctggaactcgaccgcgacgcaggagtctaacaacaccgagctgaacggcaacatcaccctgccgtgccggatcaagcagatcgtcaacatgtggcaggaggtgggcaaggctatgtacgcccctcccatccgcggccagatccggtgcagctcgaacatcaccggcctgatcctgaccagggacggcggcaacaacaactcgacgaacgagaccttcagacctggcggcggagacatgcgggacaactggcggagcgagctgtacaagtacaaggtcgtgaagatcgagcccctgggcgtcgcacccaccaaggccaagcggagagtggtgcagcgggagaagagggcggtgggaacgatcggcgccatgttcctgggcttcctgggagcggccggaagcacgatgggagccgcctcgctgaccctgaccgtgcaggcgaggctcctgctgtccggcatcgtgcagcagcagaacaacctgctgagggccatcgaggcccagcagcacctgctccagctgacagtgtggggcatcaagcagctccaggcgagggtgctggccgtcgagagatacctgaaggaccagcaactgctcggcatctggggctgtagcggcaagctgatctgtaccaccaccgtgccctggaacaccagctggagcaacaagagcctcaacgagatctgggacaacatgacctggatggagtgggagcgggagatcgacaactacacagggctcatctacacgctgctggaggagagccagaaccagcaggagaagaacgagcaggagctgctggagctggacaagtgggcgtcgctgtggaactggttcgacatcaccaagtggctgtggtacatcaagatcttcatcatgatcgtcggcggcctggtgggtctgagaatcgtcttcacggtgctgtccatcgtgaacagagtcaggcagggctacagccccctgagcttccagacccacctccctgccccgagaggccccgatagacccgaggggatcgaggaggagggaggagagcgcgacagggacaggtccggcaggcttgtagacggcttcctggcaatcatctgggtcgatctgaggagcctgtgcctgttcagctaccaccagctgagagacttcatcctgatcgcggccagaaccgtggagctgctgggccacagctcgctcaagggtctccggagaggctgggaggccctgaagtactggtggaacctgctgcagtactggtcgcaggagctgaagaacagcgccatctccctgctgaacacgaccgccatcgtggtggccgagggaaccgacagaatcatcgaggtgctgcagagagcggggagagccatcctgcacatccccacgagaatcagacagggcctggagagactgctgctctgatgaggatcc

SEQ ID NO: 661 - protein, 849 aa, Artificial Sequence
  Description of Artificial Sequence: Synthetic polypeptide
MRVKETQMNWPNLWKWGTLILGLVIICSASDNLWVTVYYGVPVWKEATTTLFCASDAKAYDTEVHNVWATYACVPTDPNPQEVVLGNVTENFNMWKNNMVEQMHEDIISLWDQSLKPCVRLTPLCVTLNCSNANTTNTNSTEEIKNCSFNITTSIRDKVQKEYALFYKLDVVPIDNDNTSYRLISCNTSVITQACPKVSFEPIPIHYCAPAGFAILKCKDKKFNGTGPCTNVSTVQCTHGIRPVVSTQLLLNGSLAEEEVVIRSENFTNNAKTIIVHLNKSVEINCTRPNNNTRKSIHIGPGRAFYATGEIIGDIRQAHCNISRAKWNNTLKQIVKKLKEQFNKTIIFNQSSGGDPEITTHSFNCGGEFFYCNTSGLFNSTWNSTATQESNNTELNGNITLPCRIKQIVNMWQEVGKAMYAPPIRGQIRCSSNITGLILTRDGGNNNSTNETFRPGGGDMRDNWRSELYKYKVVKIEPLGVAPTKAKRRVVQREKRAVGTIGAMFLGFLGAAGSTMGAASLTLTVQARLLLSGIVQQQNNLLRAIEAQQHLLQLTVWGIKQLQARVLAVERYLKDQQLLGIWGCSGKLICTTTVPWNTSWSNKSLNEIWDNMTWMEWEREIDNYTGLIYTLLEESQNQQEKNEQELLELDKWASLWNWFDITKWLWYIKIFIMIVGGLVGLRIVFTVLSIVNRVRQGYSPLSFQTHLPAPRGPDRPEGIEEEGGERDRDRSGRLVDGFLAIIWVDLRSLCLFSYHQLRDFILIAARTVELLGHSSLKGLRRGWEALKYWWNLLQYWSQELKNSAISLLNTTAIVVAEGTDRIIEVLQRAGRAILHIPTRIRQGLERLLL

SEQ ID NO: 662 - DNA, 2615 bp, Artificial Sequence
  Description of Artificial Sequence: Synthetic polynucleotide
gtcgacaagaaatgagggtccggggaatccagaggaactggccgcagtggtggatctggggcatcctgggattctggatgctgatgatctgcaacgtggtgggcaacctgtgggtgaccgtgtactacggcgtgcctgtgtggaaggaggccaagaccaccctgttctgtgcctcggacgccaaggcctacgagaaggaggtccacaacgtgtgggctacccacgcctgtgtgcccaccgacccctcgcctcaagaggtcgtgctggagaacgtgaccgagaacttcaacatgtggaagaacgacatggtggaccagatgcacgaggacgtcatcagcctgtgggaccagagcctgaagccctgcgtgaagctgacccacctgtgcgtgaccctgaactgcacgaacgccacgaacacgaactacaacaactcgacgaacgtgacgtcgtcgatgatcggggagatgaagaactgtagcttcaacatcaccaccgagatccgggacaagtcgcgcaaggagtacgccctgttctaccggctggacatcgtgccgctgaacgagcagaacagctcggagtacaggctgatcaactgtaacaccagcaccatcacccaggcctgccccaaagtcagcttcgaccccatccccatccactactgcgcgcctgccggctacgccatcctgaagtgcaacaacaagacgttcaacggcaccggcccctgcaacaacgtcagcaccgtccagtgcacccacggcatcaagcctgtggtgtccacccagctgctcctgaacggcagcctggccgagggcgagatcatcatcaggagcgagaacctgaccgacaacgccaagaccatcatcgtgcacctgaacgagtcggtggagatcgtctgcacccggcccaacaacaacacccggaagagcgtgcggatcggccctggacaggcgttctacgccacgggggacatcatcggcgacatcaggcaggcccactgcaacctgtcgcggacccagtggaacaacaccctgaagcagatcgtgacgaagctgagggagcagttcgggaacaagaccatcgtgttcaaccagagcagcggcggagacccggagatcgtgatgcactcgttcaactgcggtggcgagttcttctactgcaacacgacccagctgttcaacagcacctgggagaactccaacatcacccagcccctgaccctgaaccggaccaaggggcctaacgacaccatcacgctgccgtgccggatcaagcagatcatcaacatgtggcagggcgtgggcagggccatgtacgcccctcccatcgagggcctgatcaagtgcagctcgaacatcaccggcctgctgctgaccagagacggcggcaacaactcggagacgaagaccacggagaccttcagacctggcggcggaaacatgagagacaactggcggaacgagctgtacaagtacaaggtcgtgcagatcgagcccctgggcgtcgcacccacccgggccaagaggagagtggtggagcgggagaagagagcggtgggaatcggcgccgtgttcctgggcttcctgggaacggccggaagcaccatgggagccgcctcgatcaccctgaccgtgcaggcgaggcaggtgctgtccggcatcgtgcagcagcagtcgaacctgctgaaggccatcgaggcccagcagcacctgctcaagctgacagtgtggggcatcaagcagctccagaccagggtgctggccatcgagcgctacctgaaggaccagcagctgctcggcctgtggggctgtagcggcaagctgatctgtaccaccgcggtgccctggaacagcagctggagcaacaagagccagaccgacatctgggacaacatgacctggatgcagtgggaccgggagatctcgaactacacagacacgatctaccggctgctggaggacagccagaaccagcaggagaagaacgagaaggacctgctggcgctggacagctggaagaacctgtggaactggttcgacatcaccaactggctgtggtacatcaagatcttcatcatcatcgtcggcggcctgatcggtctgagaatcatcttcgccgtgctgtccatcgtgaacaggtgcaggcagggctacagccccctgagcctgcagaccctgatccctaacccgagaggccccgacaggctcggagggatcgaggaggagggaggagagcaggacagggacaggtccatcaggctcgtatcgggcttcctggcactcgcctgggacgacctgaggagcctgtgcctgttcagctaccaccggctgagggacttcatcctgatcgtcgcccgcgctgtggagctgctgggcaggtcgagcctccgaggtctccagagaggctgggaggccctgaagtacctgggctctctggtccagtactggggtctggagctgaagaagagcgccatctccctgctggacacgatcgccatcgcggtggccgagggaaccgacagaatcatcgaagtgatccagagaatctgcagagccatccggaacatcccccggagaatcagacagggcttcgaggctgccctgctctgatgaggatcc

SEQ ID NO: 663 - protein, 864 aa, Artificial Sequence
  Description of Artificial Sequence: Synthetic polypeptide
MRVRGIQRNWPQWWIWGILGFWMLMICNVVGNLWVTVYYGVPVWKEAKTTLFCASDAKAYEKEVHNVWATHACVPTDPSPQEVVLENVTENFNMWKNDMVDQMHEDVISLWDQSLKPCVKLTHLCVTLNCTNATNTNYNNSTNVTSSMIGEMKNCSFNITTEIRDKSRKEYALFYRLDIVPLNEQNSSEYRLINCNTSTITQACPKVSFDPIPIHYCAPAGYAILKCNNKTFNGTGPCNNVSTVQCTHGIKPVVSTQLLLNGSLAEGEIIIRSENLTDNAKTIIVHLNESVEIVCTRPNNNTRKSVRIGPGQAFYATGDIIGDIRQAHCNLSRTQWNNTLKQIVTKLREQFGNKTIVFNQSSGGDPEIVMHSFNCGGEFFYCNTTQLFNSTWENSNITQPLTLNRTKGPNDTITLPCRIKQIINMWQGVGRAMYAPPIEGLIKCSSNITGLLLTRDGGNNSETKTTETFRPGGGNMRDNWRNELYKYKVVQIEPLGVAPTRAKRRVVEREKRAVGIGAVFLGFLGTAGSTMGAASITLTVQARQVLSGIVQQQSNLLKAIEAQQHLLKLTVWGIKQLQTRVLAIERYLKDQQLLGLWGCSGKLICTTAVPWNSSWSNKSQTDIWDNMTWMQWDREISNYTDTIYRLLEDSQNQQEKNEKDLLALDSWKNLWNWFDITNWLWYIKIFIIIVGGLIGLRIIFAVLSIVNRCRQGYSPLSLQTLIPNPRGPDRLGGIEEEGGEQDRDRSIRLVSGFLALAWDDLRSLCLFSYHRLRDFILIVARAVELLGRSSLRGLQRGWEALKYLGSLVQYWGLELKKSAISLLDTIAIAVAEGTDRIIEVIQRICRAIRNIPRRIRQGFEAALL

SEQ ID NO: 664 - protein, 79 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQE

SEQ ID NO: 665 - protein, 33 aa, Artificial Sequence
  Description of Artificial Sequence: Synthetic polypeptide
TRPNNNTRKSIRIGPGQTFYATGDIIGNIRQAH

What is claimed is:

1. A recombinant HIV-1 envelope protein wherein the recombinant HIV-1envelope protein is a HIV-1 gp160 M5 envelope protein comprising amino acids 30 through 846 of SEQ ID NO:307, a HIV-1 gp140 M5 envelope protein derived from a HIV-1 gp160 M5 envelope protein comprising amino acids 30 through 846 of SEQ ID NO:307, a HIV-1 gp145 M5 envelope protein comprising amino acids 30 through 694 of SEQ ID NO:469, a HIV-1 gp120d8 M5 envelope protein comprising amino acids 29through 486 of SEQ ID NO:322, or a HIV-1 gp120 M5 envelope protein comprising amino acid sequence MWVTVYYG followed immediately by amino acids 30 through 486 of SEQ ID NO:322.

2. The recombinant HIV-1 envelope protein according to claim 1, wherein the recombinant HIV-1 envelope protein is a HIV-1 gp120d8 M5 envelope protein comprising amino acids 29 through 486 of SEQ ID NO:322.

3. The recombinant HIV-1 envelope protein according to claim 1, wherein the recombinant HIV-1 envelope protein is a HIV-1 gp120 M5 envelope protein comprising amino acid sequence MWVTVYYG followed immediately by amino acids 30 through 486 of SEQ ID NO:322.

4. The recombinant HIV-1 envelope protein according to claim 1, wherein the recombinant HIV-1 envelope protein is a HIV-1 gp140 M5 envelope protein derived from a HIV-1 gp160 M5 envelope protein comprising amino acids 30 through 846 of SEQ ID NO:307.

5. The recombinant HIV-1 envelope protein according to claim 1, wherein the recombinant HIV-1 envelope protein is a HIV-1 gp145 M5 envelope protein comprising amino acids 30 through 694 of SEQ ID NO:469.

6. The recombinant HIV-1 envelope protein according to claim 1, wherein the recombinant HIV-1 envelope protein is a HIV-1 gp160 M5 envelope protein comprising amino acids 30 through 846 of SEQ ID NO:307.

7. A nucleic acid comprising a nucleotide sequence encoding any one of the HIV-1 envelope proteins according to claim 1.

8. A vector comprising the nucleic acid according to claim 7, wherein the nucleic acid is operably linked to a promoter.

9. A composition comprising any one of the recombinant HIV-1 envelope proteins according to claim 1, and an adjuvant.

10. A composition comprising said nucleic acid according to claim 7 and an adjuvant.

11. A composition comprising said vector according to claim 8 and an adjuvant.

12. A method of inducing an immune response to HIV-1 comprising administering a composition comprising any one of the recombinant HIV-1 envelope proteins according claim 1, to a subject in an amount sufficient to effect said induction.

13. The method of claim 12, wherein the composition comprises an adjuvant.

14. A method of inducing an immune response to HIV-1 comprising administering a composition comprising said nucleic acid according to claim 7 to a subject in an amount sufficient to effect said induction.

15. The method of claim 14, wherein the composition comprises an adjuvant.

16. A method of inducing an immune response to HIV-1 comprising administering a composition comprising
  a. said vector according to claim 8; and
  b. an adjuvant to a subject in an amount sufficient to effect said induction.

17. The method of claim 15, wherein the composition is administered as a prime in a prime boost regimen.

18. The method of claim 17, wherein a composition comprising at least one additional HIV-1 envelope protein from Table 14 or any combination thereof is administered as a boost in a prime boost regimen.

19. The method of claim 16, wherein the composition is administered as a prime in a prime boost regimen.

20. The method of claim 19, wherein a composition comprising at least one additional HIV-1 envelope protein from Table 14 or any combination thereof is administered as a boost in a prime boost regimen.

* * * * *

UNITED STATES PATENT AND TRADEMARK OFFICE
CERTIFICATE OF CORRECTION

PATENT NO.        : 10,149,902 B2
APPLICATION NO.   : 15/126220
DATED             : December 11, 2018
INVENTOR(S)       : Barton F. Haynes et al.

Page 1 of 1

It is certified that error appears in the above-identified patent and that said Letters Patent is hereby corrected as shown below:

In the Specification

At Column 1, Line numbers 11-15 replace with the following:
"The United States government has rights in this invention pursuant to Contract No. DE-AC52-06NA25396 between the United States Department of Energy and Los Alamos National Security, LLC for the operation of Los Alamos National Laboratory."

Signed and Sealed this
Twenty-sixth Day of January, 2021

Drew Hirshfeld
*Performing the Functions and Duties of the*
*Under Secretary of Commerce for Intellectual Property and*
*Director of the United States Patent and Trademark Office*